(12) United States Patent
Tani et al.

(10) Patent No.: US 11,753,448 B2
(45) Date of Patent: Sep. 12, 2023

(54) OPTICALLY CONTROLLED VIRUS PROTEIN, GENE THEREOF, AND VIRUS VECTOR CONTAINING SAID GENE

(71) Applicant: THE UNIVERSITY OF TOKYO, Tokyo (JP)

(72) Inventors: Kenzaburo Tani, Tokyo (JP); Moritoshi Sato, Tokyo (JP); Makoto Takeda, Tokyo (JP); Maino Tahara, Tokyo (JP)

(73) Assignee: THE UNIVERSITY OF TOKYO, Tokyo (JP)

( * ) Notice: Subject to any disclaimer, the term of this patent is extended or adjusted under 35 U.S.C. 154(b) by 671 days.

(21) Appl. No.: 16/629,925

(22) PCT Filed: Jul. 11, 2018

(86) PCT No.: PCT/JP2018/026211
§ 371 (c)(1),
(2) Date: Jan. 9, 2020

(87) PCT Pub. No.: WO2019/013258
PCT Pub. Date: Jan. 17, 2019

(65) Prior Publication Data
US 2021/0087234 A1 Mar. 25, 2021

(30) Foreign Application Priority Data
Jul. 11, 2017 (JP) ................................. 2017-135579

(51) Int. Cl.
*C07K 14/08* (2006.01)
*C12N 5/10* (2006.01)
(Continued)

(52) U.S. Cl.
CPC ............ *C07K 14/08* (2013.01); *C07K 14/005* (2013.01); *C12N 5/10* (2013.01); *C12N 7/00* (2013.01);
(Continued)

(58) Field of Classification Search
CPC ......................... C12N 2740/1304; C07K 14/08
See application file for complete search history.

(56) References Cited

U.S. PATENT DOCUMENTS

2018/0163195 A1* 6/2018 Wong ....................... C12N 9/00

FOREIGN PATENT DOCUMENTS

WO 2017/053629 A2 3/2017

OTHER PUBLICATIONS

Duprex, W. Paul, Fergal M. Collins, and Bert K. Rima. "Modulating the function of the measles virus RNA-dependent RNA polymerase by insertion of green fluorescent protein into the open reading frame." Journal of virology 76.14 (2002): 7322-7328. (Year: 2002).*
(Continued)

*Primary Examiner* — Weihua Fan
(74) *Attorney, Agent, or Firm* — Mintz Levin Cohn Ferris Glovsky and Popeo, P.C.

(57) ABSTRACT

The purpose of the present invention is to develop a virus vector, the activity of which is rendered controllable. A virus protein gene derived from an RNA virus is provided in which a gene encoding an optical switch protein is inserted into a foreign gene introducible region of the virus protein so as to enable expression of the gene. By means of this virus vector, it is possible to control, with irradiation of light, enzyme activity of the virus protein and virus vector activity based thereon.

20 Claims, 17 Drawing Sheets

Specification includes a Sequence Listing.

(51) Int. Cl.
  C12N 15/62    (2006.01)
  C12N 7/00     (2006.01)
  C12N 15/86    (2006.01)
  C07K 14/005   (2006.01)
  C12N 15/63    (2006.01)
  C12N 5/074    (2010.01)

(52) U.S. Cl.
  CPC .............. *C12N 15/62* (2013.01); *C12N 15/63* (2013.01); *C12N 15/86* (2013.01); *C12N 5/0696* (2013.01); *C12N 2501/602* (2013.01); *C12N 2501/603* (2013.01); *C12N 2501/604* (2013.01); *C12N 2501/606* (2013.01); *C12N 2506/45* (2013.01); *C12N 2760/18422* (2013.01); *C12N 2760/18443* (2013.01)

(56) References Cited

OTHER PUBLICATIONS

Hiramoto, Takafumi, et al. "5. Newly developed measles virus vector can simultaneously transfer multiple genes into human hematopoietic cells and induce ground state like pluripotent stem cells." Molecular Therapy 23 (2015): S2-S3. (Year: 2015).*

International Search Report dated Oct. 9, 2018 corresponding to PCT/JP2018/026211 filed Jul. 11, 2018; 2 pages. English translation.

Duprex, W. Paul et al., "Modulating the Function of the Measles Virus RNA-Dependent RNA Polymerase by Insertion of Green Fluorescent Protein into the Open Reading Frame," *J. Virol.* (Jul. 2002) 76(14)7322-7328.

Frolova, Elena et al., "Formation of nsP3-Specific Protein Complexes during Sindbis Virus Replication," *Journal of Virology* (Apr. 2006) 4122-4134.

Furuya, Akihiro et al., "Assembly Domain-Based Optogenetic System for the Efficient Control of Cellular Signaling," *ACS Synth. Biol.* (Feb. 14, 2017) 6:1086-1095.

Kawano, Fuun et al., "Engineered pairs of distinct photoswitches for optogenetic control of cellular proteins," *Nat. Commun.* (Feb. 24, 2015) 6:6256; 8 pages.

Kawano, Fuun et al., "A photoactivatable Cre-loxP recombination system for optogenetic genome engineering," *Nature Chemical Biology* (Published online Oct. 10, 2016) 12:1059-1064.

Liu, Hongtao, "Optogenetic Control of Transcription in Zebrafish," *PLOS One* (Nov. 30, 2012) 7(11):e50738; 5 pages.

Khawplod, Pakamatz et al., "A novel rapid fluorescent focus inhibition test for rabies virus using a recombinant rabies virus visualizing a green fluorescent protein," *Journal of Virological Methods* (Available online Jan. 11, 2005) 125:35-40.

Matthews, Jason D. et al., "Analysis of the function of cytoplasmic fibers formed by the rubella virus nonstructural replicase proteins," *Virology* (2010; Available online Aug. 8, 2010) 406:212-227.

McIlhatton, M. A. et al., "Nucleotide sequence analysis of the large (L) genes of phocine distemper virus and canine distemper virus (corrected sequence)," *Journal of General Virology* (1997; Accepted Nov. 15, 1996) 78:571-576.

Nakatsu, Yuichiro et al., "Rescue system for measles virus from cloned cDNA driven by vaccinia virus Lister vaccine strain," *Journal of Virological Methods* (Available online Jul. 18, 2006) 137:152-155.

Nihongaki, Yuta et al., "Photoactivatable CRISPR-Cas9 for optogenetic genome editing," *Nat. Biotechnol.* (Published online Jun. 15, 2015) 33(7):755-760.

Poch, Olivier et al., "Sequence comparison of five polymerases (L proteins) of unsegmented negative-strand RNA viruses: theoretical assignment of functional domains," *Journal of General Virology* (1990; Accepted Jan. 18, 1990) 71:1153-1162.

Rager, Monika et al., "Polyploid measles virus with hexameric genome length," *The EMBO Journal* (2002; revised and accepted Mar. 25, 2002) 21(10):2364-2372.

Sakata, Masafumi et al., "Short Self-Interacting N-Terminal Region of Rubella Virus Capsid Protein Is Essential for Cooperative Actions of Capsid and Nonstructural p150 Proteins," *Journal of Virology* (Oct. 2014) 88(19):11187-11198.

Shigemitsu, Yusuke et al., "Fabrication of biodegradable β-tricalcium phosphate/poly(L-lactic acid) hybrids and their in vitro biocompatibility," *Journal of the Ceramic Society of Japan* (2010; accepted Oct. 4, 2010) 118(12):1181-1187.

Silin, D. et al., "Development of a Challenge-Protective Vaccine Concept by Modification of the Viral RNA-Dependent RNA Polymerase of Canine Distemper Virus," *J. Virol.* (Dec. 2007) 81(24):13649-13658.

Takeda, Makoto et al., "Efficient rescue of measles virus from cloned cDNA using SLAM-expressing Chinese hamster ovary cells," *Virus Research* (2005; available online Oct. 22, 2004) 108:161-165.

Takeda, Makoto et al., "Generation of Measles Virus with a Segmented RNA Genome," *Journal of Virology* (May 2006) 80(9):4242-4248.

The University of Tokyo, Small photoswitching proteins are the fastest in the world, The University of Tokyo, May 28, 2015, retrieved on Sep. 11, 2018, retrieved from the Internet, URL;https://www.u-Tokyo.ac.jp/focus/ja/articles/a_00382.html; 2 pages.

The University of Tokyo "Controlling CRISPR-cas9 system, leading to freer genome editing", Jun. 23, 2015, retrieved on Sep. 11, 2018, retrieved from the Internet, URL;http://smcjapan.org/?p=4060; 4 pages.

Tzeng, Wen-Pin et al., "Functional Replacement of a Domain in the Rubella Virus P150 Replicase Protein by the Virus Capsid Protein," *Journal of Virology* (Apr. 2009) 83(8):3549-3555.

Yu, Gaigai et al., "Optical manipulation of the alpha subunits of heterotrimeric G proteins using photoswitchable dimerization systems," *Scientific Reports* (Oct. 21, 2016) 6:35777; 9 pages.

Zhou, Xin X. et al., "Optical Control of Protein Activity by Fluorescent Protein Domains," *Science* (Nov. 9, 2012) 338:810-814.

* cited by examiner

FIG. 1
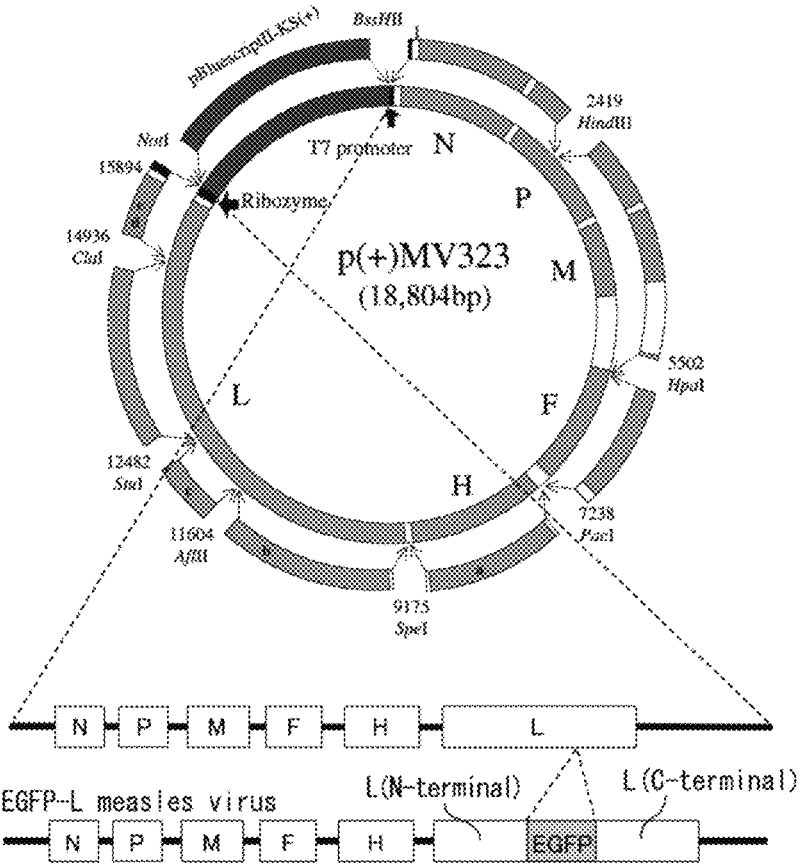
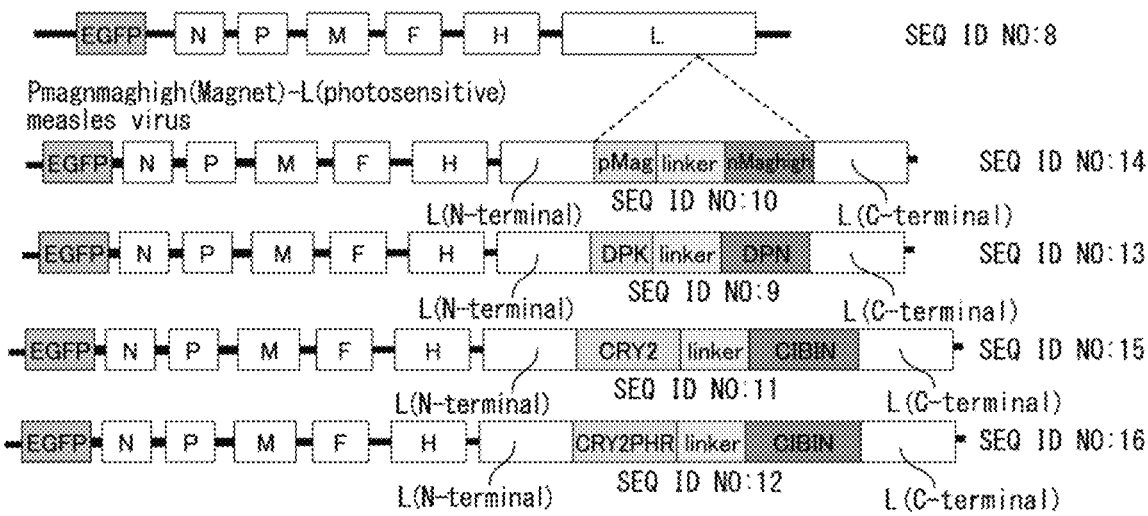

FIG. 11

FIG. 16
(A)
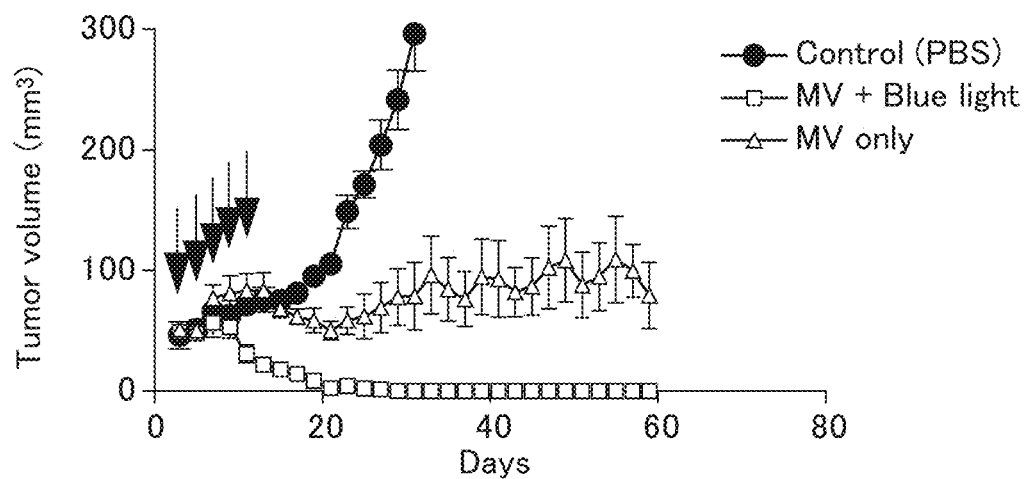
(B)
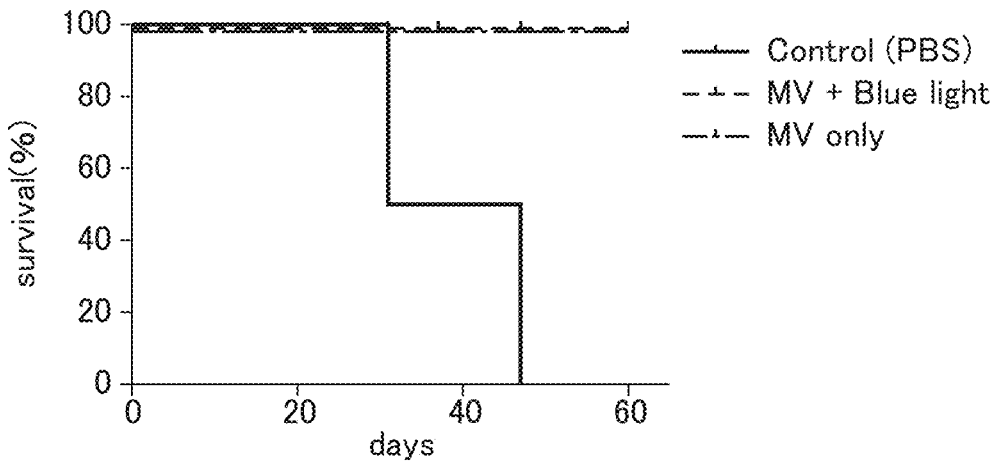

OPTICALLY CONTROLLED VIRUS PROTEIN, GENE THEREOF, AND VIRUS VECTOR CONTAINING SAID GENE

FIELD

The present invention relates to technology for controlling the enzyme activity of a virus protein by irradiation of light.

BACKGROUND

Advances in biotechnology have led to the establishment of gene transfer technologies using virus vectors, and have enabled research on gene therapies for a host of diseases including serious genetic diseases such as ADA deficiency, as well as cancer and AIDS. Gene transfer technologies are largely divided into non-virus transfer methods, and transfer methods that employ viruses. However, non-virus transfection techniques generally tend to have low transfer efficiency, while the expression efficiency of the transferred genes is also low. Gene transfer technologies that utilize viruses are used in gene therapy, and a large number of virus vectors have been developed.

Virus vectors allow transfer of exogenous genes utilizing the infectivity which viruses innately have. The expression of the exogenous gene in infected cells can be attained by placing an exogenous gene under the control of a promoter. A wide variety of viruses can be used as such virus vectors, including retroviruses for the purpose of integration into genomes, and adenoviruses or adeno-associated viruses for the purpose of transient gene expression.

However, no method has yet been developed for controlling the activity of virus vectors after infection when existing virus vectors have been used. When a retrovirus is used for the purpose of integration into a genome, it has been the case that the virus remains even after integration into the genome has been completed, resulting in side-effects. Even when adenoviruses or adeno-associated viruses are used for the purpose of transient gene expression, there is a noted risk of the viruses remaining in different types of body tissues, and vector rescue occurring between latent viruses that have already infected a human.

CITATION LIST

Non-Patent Literature

[NPL 1] J. General virology (1990), 71, 1153-1162; J. General Virology (1997), 78, 571-576
[NPL 2] Virology (2010) vol. 406 p. 212-227
[NPL 3] J. Virology (2006) vol. 80, No. 8, p. 4122-4134
[NPL 4] J. Virology (2002) vol. 76, No. 14, 7322-7328
[NPL 5] J. Virology (2007) vol. 81, No. 24, 13649-13658
[NPL 6] Vaccine (2010) vol. 28, p. 1181-1187
[NPL 7] J Virology, (2009) vol. 83, p. 3549-3555
[NPL 8] Nature Chemical Biology, DOI10.1038/nchembio.2205
[NPL 9] Nature Biotechnology (2015) vol. 33, 755-760, doi:10.1038/nbt.3245
[NPL 10] Embo J. (2002) vol. 21(10):2364-72
[NPL 11] J. Virol. (2006) vol. 80:4242-4248
[NPL 12] Virus Res (2005) vol. 108:161-165
[NPL 13] J Virological Methods (2006) vol. 137:152-155
[NPL 14] Journal of Virological methods (2005) vol. 125: 35-40
[NPL 15] Journal of Virology (2014) vol. 88:11187-11198
[NPL 16] Science, (2012) vol. 338, 810-814

SUMMARY

Technical Problem

It is an object of the present invention to develop a virus vector that allows control of the virus vector activity.

Solution to Problem

The present inventors have found that by inserting a gene coding for an optical switch protein into an exogenous gene-transferable region of a virus protein including multiple functional domains, it is possible to control the enzyme activity of the virus protein by irradiation of light, and have thereupon completed this invention.

The present invention relates to the following inventions:

[1] A virus protein gene in which a gene coding for an optical switch protein is inserted in an expressible manner in an exogenous gene-transferable region of a virus protein that has an enzyme activity, wherein the optical switch protein comprises at least two subunits, and the genes coding for each subunit either are linked together by a gene, or directly linked together without a linker.

[2] The virus protein gene according to [1], wherein the linker has 10 to 100 amino acid residues.

[3] The virus protein gene according to [1] or [2], wherein the gene coding for an optical switch protein is Magnet gene.

[4] The virus protein gene according to [3], wherein the activity of the virus protein can be adjusted by irradiating light with a wavelength of 450 to 490 nm.

[5] The virus protein gene according to any one of [1] to [4], wherein the virus protein that has enzyme activity is a virus protein having a polymerase or protease domain.

[6] The virus protein gene according to any one of [1] to [5], wherein the virus is an RNA virus.

[7] The virus protein gene according to any one of [1] to [6], wherein the virus protein is an RNA-dependent RNA polymerase.

[8] The virus protein gene according to [7], wherein the RNA-dependent RNA polymerase is RNA-dependent RNA polymerase L protein.

[9] The virus protein gene according to [7] or [8], wherein the exogenous gene-transferable region is a region between the Ln domain and the Lc domain.

[10] The virus protein gene according to any one of [1] to [9], which further includes a linker further upstream and/or downstream from the gene coding for an optical switch protein.

[11] A nucleic acid encoding the virus protein gene according to any one of [1] to [10].

[12] A vector that includes a nucleic acid encoding the virus protein gene according to any one of [1] to [10].

[13] A virus or virus vector that includes the virus protein gene according to any one of [1] to [10].

[14] A kit that includes a nucleic acid according to [11], a vector according to [11], or a virus or virus vector according to [12].

[15] Cells including a nucleic acid according to [11].

[16] Cells according to [15], wherein the cells are iPS cells or their progeny cells.

[17] A method for infecting cells transiently with a virus vector, comprising:
infecting the cells with a virus or virus vector according to [13] that includes a transgene, culturing the infected cells under light irradiation, and culturing the infected cells under no light irradiation.

[18] A method for expressing a transgene, comprising:
infecting cells with a virus or virus vector according to [13] that includes a transgene, and
culturing the infected cells under light irradiation.

[19] A method for producing iPS cells, comprising:
infecting somatic cells with a virus or virus vector according to [13] that includes one or more transgenes selected from the group consisting of Oct3/4, Sox2, Klf4, l-Myc (or c-Myc), Nanog and Lin28, and
culturing the infected cells under light irradiation.

[20] The method according to [18] or [19], further comprising a step of culturing the infected cells under no light irradiation.

Advantageous Effects of Invention

The optically controllable virus protein of the invention allows regulation of its enzyme activity by the presence or absence of light irradiation. Since the enzyme activity of a virus protein contributes an activity of the virus, such as the proliferation and infection, it is possible, by the presence or absence of light irradiation, to control the activity of a virus vector or virus having the optically controllable virus protein gene.

BRIEF DESCRIPTION OF DRAWINGS

FIG. 1 schematically shows a plasmid encoding the genomic sequence of measles virus, and the genomes of measles virus and recombinant measles virus.

FIG. 3 is a graph showing measles virus counts (PFU/ml) cultured under blue light irradiation, under red light irradiation or in a dark environment, at different days after infection of cells with a photosensitive measles virus vector according to the invention.

FIG. 4 is a graph showing measles virus counts (PFU/ml) cultured under blue light irradiation, under red light irradiation or in a dark environment, at different days after infection of cells with a photosensitive measles virus vector according to the invention. Here it is shown that the virus count decreased by culturing in the dark environment after culturing under blue light irradiation up to the 3rd day.

FIG. 5 is a graph showing measles virus counts (PFU/ml) cultured under blue light irradiation, under red light irradiation or in a dark environment, at different days after infection of cells with a photosensitive measles virus vector according to the invention. Here it is shown that virus activity was restored and proliferation occurred by culturing under blue light irradiation from the 7th day, after culturing in a dark environment up to the 7th day.

FIG. 6 shows a schematic diagram of a measles virus mini-genome expression plasmid. It has hammerhead ribozyme, the measles virus genome 5'-terminal sequence, nanoluciferase, the measles virus 3'-terminal sequence and HDV ribozyme, each linked in an expressible manner downstream from the EF1α promoter. When this plasmid is transfected into cells, RNA is transcribed by the activity of the EF1α promoter and the ribozyme sequences are cleaved by the action of the ribozyme, producing a measles virus mini-genome.

FIG. 7 shows a schematic diagram of an N protein expression plasmid, P protein expression plasmid and L (or modified L) protein expression plasmid, having the N gene, P gene and L gene, respectively, arranged downstream from the CAG promoter, and the measles virus mini-genome expression plasmid. When these plasmids are cotransfected into cells, the N protein, P protein and L protein (or modified L protein) are translated and produced, and the measles virus mini-genome is also produced. These produce ribonucleoprotein complexes in the cells, while the action of the RNA-dependent RNA polymerase of L protein results in production of mRNA and expression of the protein encoded in the mini-genome (nanoluciferase).

FIG. 8 shows luciferase activity after cotransfection with the N protein expression plasmid, P protein expression plasmid and measles virus mini-genome expression plasmid, together with L protein or modified L protein. The results are shown for culturing in a dark environment or under blue light irradiation.

FIG. 9 is a diagram schematically showing virus vectors, having either a gene with the N-terminal end of the L gene linked with pMag, or a gene with the C-terminal end of the L gene linked with nMaghigh gene, at the L gene location of measles virus vector.

FIG. 10 is a schematic diagram of sequences having an EGFP transcription unit, an optical switch protein unit (pMag-linker-nMaghigh), an optical switch protein unit (pMag-linker-nMag) and an direct bond optical switch protein unit (pMag-Direct-nMaghigh), added to the sequence of rabies virus.

FIG. 11 is a schematic diagram of sequences having AG1 and an optical switch protein unit (pMag-linker-nMaghigh) introduced into the exogenous gene-transferable region of p150 protein within the sequence of rubella virus.

FIG. 12 is a schematic diagram of a reporter gene-expressing subgenomic replicon having an optical switch protein unit (pMag-linker-nMaghigh) transferred into the exogenous gene-transferable region of p150 protein within the sequence of rubella virus, and also having the structural protein region replaced with a reporter gene (nanoluciferase).

FIG. 13 schematically shows the genomes of measles virus and recombinant measles virus. For optical switch protein units transferred into recombinant measles virus, there were created one using a 26-residue linker (pMag-linker-nMaghigh), one in which the linker connecting the subunits was lengthened by approximately 4 times (pMag-4×linker-nMaghigh), and one with direct linkage without using a linker (pMag-direct-nMaghigh). As an optical switch protein subunit there was also created recombinant measles virus (pMag-linker-nMag) using nMag instead of nMaghigh.

FIG. 14 is a graph showing measles virus counts (PFU/ml), when cultured cells were infected with the recombinant measles viruses prepared in FIG. 13 and cultured either under blue light irradiation or in a dark environment.

FIG. 15 is a graph showing rabies virus counts (PFU/ml), after culturing with the recombinant rabies viruses prepared in FIG. 10, either under blue light irradiation or in a dark environment.

FIG. 16 shows a graph showing change in tumor volume by blue light irradiation (A) and a graph showing survival rates (B), after infection of recombinant measles virus into tumors in a tumor mouse model.

FIG. 17 shows a schematic diagram of a measles virus genome for preparation of iPS cells. FIG. 17B shows iPS cells prepared by infection with the virus vector for preparation of iPS cells, with the EGFP being expressed in the cells.

DESCRIPTION OF EMBODIMENTS

Figure 2:
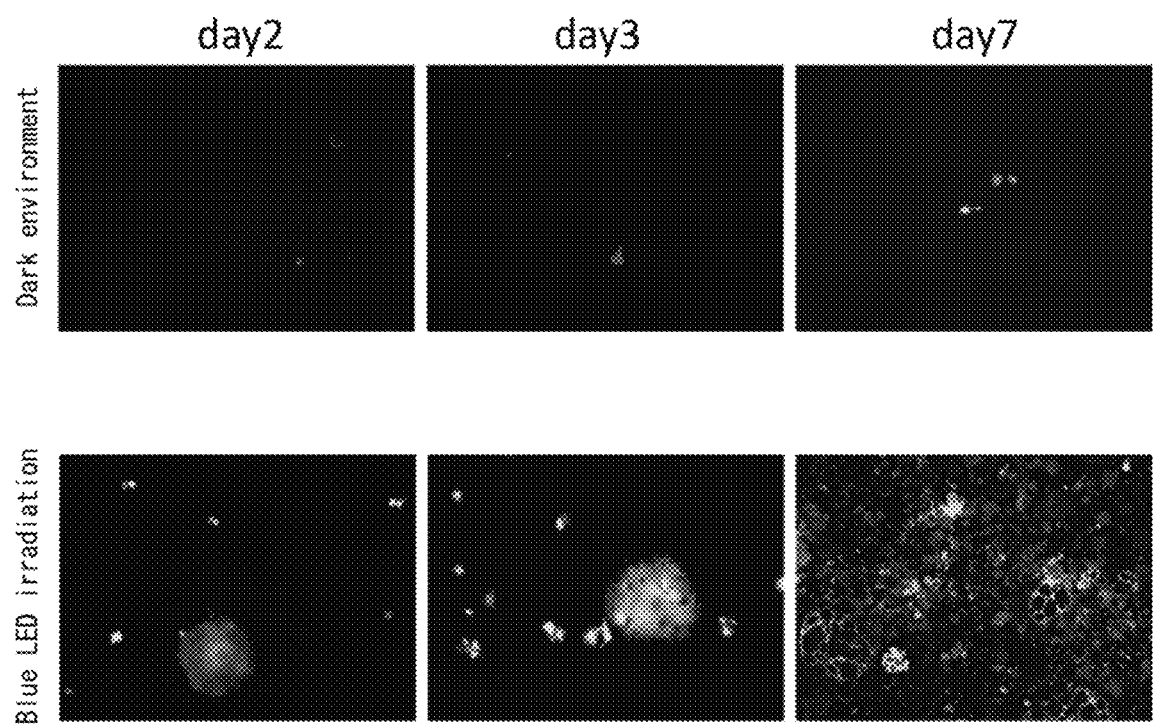
FIG. 2 is a set of photographs showing expression of EGFP at different days after infection of cells with a photosensitive measles virus vector according to the invention.
Figure 3:
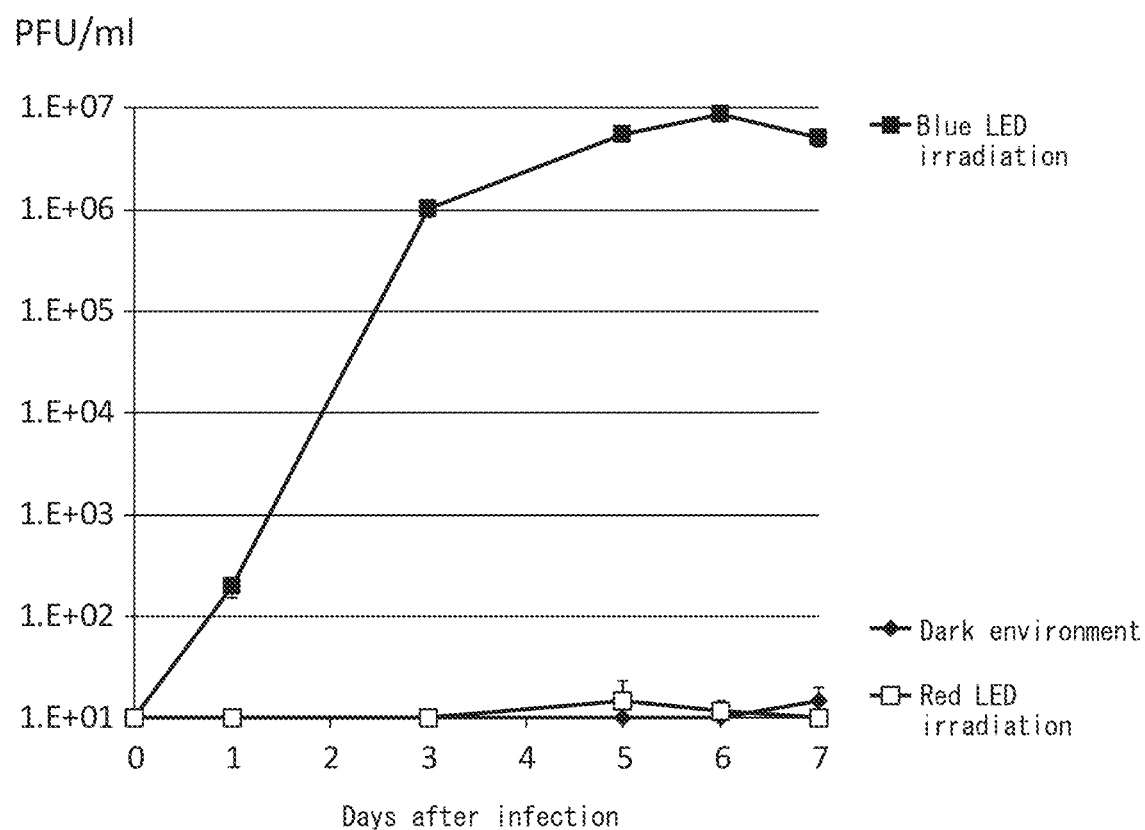

The present invention relates to a virus protein gene in which a gene coding for an optical switch protein is inserted in an expressible manner into an exogenous gene-transferable region of the virus protein that includes multiple functional domains. It is characterized in that the optical switch protein includes at least two subunits, with the genes coding for each subunit being linked with a linker.

According to another aspect, the invention relates to a virus protein gene in which a gene coding for an optical switch protein is inserted in an expressible manner into an exogenous gene-transferable region of the virus protein that includes multiple functional domains. It is characterized in that the optical switch protein includes at least two subunits, with the genes coding for each subunit being directly linked without a linker.

Each subunit may have a substitution, deletion or addition of one or more amino acids, as long as a desired activity is exhibited. In particular, an amino acid may have a deletion in the subunit at the position where the subunit is linked with or without a linker.

Viruses are generally classified as RNA viruses or DNA viruses, depending on their genome type. They are further classified based on whether the genome is composed of a single strand or composed of a double strand, and when the genome is composed of a single strand, they are further subdivided depending on whether the strand is a plus strand or minus strand. According to the invention, "virus" refers to both DNA viruses and RNA viruses, preferably to RNA viruses. RNA viruses are classified from Group III to Group VI by the International Committee on Taxonomy of Viruses, and for the purpose of the invention, viruses may be any RNA viruses belonging to any of Group III to Group VI. Most preferably, from the viewpoint of transferring an optical switch protein into L protein that has RNA-dependent RNA polymerase activity, the virus of the invention is a virus belonging to the single-stranded RNA minus strand group (Group V). From the viewpoint of transferring an optical switch protein into p150, the virus of the invention is preferably a virus belonging to the single-stranded RNA plus strand group (Group IV).

Viruses having single-stranded RNA minus strand genomes, belonging to group V according to international virus taxonomy, include viruses of the family Paramyxoviridae, the family Rhabdoviridae, the family Filoviridae and the family Bornaviridae of the order Mononegavirales, and of the family Orthomyxoviridae, the family Arenaviridae and the family Bunyaviridae of unassigned order. These viruses require RNA-dependent RNA proteins for replication in the genome, and they contain L protein or one of its family. Therefore, an optical switch protein can be introduced into an exogenous gene-transferable region of the L protein or its family proteins in these viruses. In particular, L proteins of vesicular stomatitis virus or rabies virus belonging to Rhabdoviridae, and measles virus, Sendai virus, Newcastle disease virus, canine distemper virus, phocine distemper virus or rinderpest virus belonging to Paramyxoviridae are all known to have extremely high homology (NPL 1: J. General virology (1990), 71, 1153-1162; J. General virology (1997), 78, 571-576).

Viruses having single-stranded RNA plus strand genomes, belonging to group IV according to international virus taxonomy, include viruses of the family Coronaviridae and the family Arteriviridae of the order Nidovirales, of the family Picornaviridae of the order Picornavirales, and of the family Togaviridae, the family Flaviviridae, the family Caliciviridae, the family Astroviridae and the family Hepeviridae, of unassigned order. Preferred among these viruses are viruses belonging to the genus Rubivirus of the family Togaviridae, which contain p150 protein and p90 protein, or viruses belonging to the genus Alphavirus of the family Togaviridae which contain nsP1, nsP2, nsP3 and nsP4, with rubella viruses of the genus Rubivirus being especially preferred. There may also be mentioned viruses of the family Retroviridae, of unassigned order, as viruses of group VI according to international virus taxonomy, which have single-stranded RNA plus strands and reverse transcriptase.

Viruses having genome sizes with a maximum of 300,000 bases have been discovered in DNA virus. RNA viruses, on the other hand, have relatively smaller size genomes compared to DNA viruses, with genome sizes of about 10,000 bases on average and about 30,000 bases at most. RNA viruses therefore also have relatively few virus proteins encoded in their own virus genomes. For example, measles viruses which are classified in genus Morbillivirus, family Paramyxoviridae, order Mononegavirales, have single-stranded RNA genomes with minus strands of about 16k bases, being composed of 6 genes designated as N, P, M, F, H and L from the 3'-end. Rubella viruses, classified in genus Rubivirus, family Togaviridae, have single-stranded RNA plus strands of approximately 12k bases and comprise genes designated as p150, p90, capsid, E2 and E1, from the 3'-end.

Virus proteins are largely classified as structural proteins that are the constituent components of the viral particles, and non-structural proteins that are expressed in infected cells and function for viral RNA synthesis and anti-immunity but are not incorporated into the viral particles. The phrase "virus protein that has enzyme activity" as used according to the invention may refer to either a structural protein or a non-structural protein. Virus proteins that have enzyme activity include polymerases, proteases, cap methyltransferases, helicases, integrases and neuraminidases. Proteins with enzyme activity are generally proteins that are essential for infection and proliferation of the viruses, and when their function is inhibited the viruses have their activity reduced, and in some cases are inactivated. Most proteins with enzyme activity have one or multiple functional domains. Functional domains include domains that directly affect the enzyme activity, such as polymerase domains or protease domains, and domains that function in an auxiliary manner to the enzyme activity domains. There are hinge domains or domains of unknown function (or non-exhibited function) between such domains, and exogenous genes can be introduced between the domains. A region that can allows the activity of a protein with enzyme activity to be maintained even after introduction of an exogenous gene is referred to as an "exogenous gene-transferable region".

Examples of proteins with enzyme activity that have exogenous gene-transferable regions include measles virus L protein, rubella virus p150 (NPL 2: Virology 406 (2010) p. 212-227) and non-structural protein P3 of sindbis virus (NPL 3: J. Virology (2006), vol. 80, No. 8, p. 4122-4134), but it is not intended to be limited thereto. A person skilled in the art can select any virus protein gene having an exogenous gene-transferable region. The size of a gene that can be transferred into an exogenous gene-transferable region will vary widely depending on the type of virus protein that includes the exogenous gene-transferable region. Even in the exogenous gene-transferable region, the genes that may be transferred will generally vary depending on their size and on their spatial configuration after translation. The upper limit for the transferable gene size can be selected as desired in a range in which the virus protein activity is maintained, and it may be, for example, no greater than 1000 amino acid residues, preferably no greater than 500 amino acid residues and more preferably no greater than 400 amino acid residues. There is no particular need to restrict the lower limit for the size of a transferable gene.

L protein is an RNA-dependent RNA polymerase possessed by all viruses belonging to the order Mononegavirales. The order Mononegavirales includes 5 families, and Mononegavirales viruses belonging to different families still have numerous similarities in their L protein structures, containing the RNA-dependent RNA polymerase domain, the capping domain, the connector domain, the methyltransferase domain and the C-terminal domain. The regions with exceptionally high amino acid sequence homology of L protein among Mononegavirales viruses are named domains I, II, III, IV, V and VI. The L proteins in morbilliviruses have even higher amino acid sequence homology, with the highly homologous regions being named domains D1 to D3. These domains are linked by variable hinge domains (H1 and H2). The H2 domain is an exogenous gene-transferable region. Therefore, L protein is divided into the N-terminal domain (Ln) including D1, H1 and D2 and the C-terminal domain including the D3 domain (Lc), and an exogenous gene can be introduced between Ln and Lc. More specifically, in the case of measles virus L protein, the region from the start codon up to residue 1707 may be considered the Ln domain and the region from residue 1708 to residue 2181 may be considered the Lc domain. It is known that exogenous polypeptides of about 250 residues can be introduced into this exogenous gene-transferable region without affecting the L protein activity (NPL 4: J. Virology (2002) vol. 76, No. 14, 7322-7328, NPL 5:J. Virology (2007) vol. 81, No. 24, 13649-13658), but a polypeptide of any desired size may be introduced so long as the L protein activity is not lost. Although it is not our intention to be limited to any particular theory, while polypeptides of 800 residues or longer can be introduced since L protein activity is exhibited so long as the Ln domain and Lc domain are situated in proximity, the upper limit is preferably no greater than 800 residues, more preferably no greater than 600 residues, even more preferably no greater than 400 residues and yet more preferably no greater than 300 residues.

Protein p150 is composed of a methyltransferase domain, a macro domain (X domain) and a protease domain, at the amino end. A proline hinge (PH) domain and a Y domain of unknown function are present upstream from the X domain. A Q domain including the PH domain has an exogenous gene-transferable region, which is known to allow introduction of exogenous polypeptides of about 250 residues without affecting the activity of the p150 protein (NPL 6, Vaccine 28 (2010), p. 1181-118'7, NPL 7: J Virology, 2009, vol. 83, p. 3549-3555). While polypeptides of 800 residues or longer can be introduced so long as p150 activity can be exhibited, the upper limit is preferably no greater than 800 residues, more preferably no greater than 600 residues, even more preferably no greater than 400 residues and yet more preferably no greater than 300 residues.

An optical switch protein is a photosensitive protein that allows control of its own activity or the activity of another protein by irradiation of light of a specific wavelength. Various proteins are known as photosensitive proteins, including rhodopsin and the photoreceptor protein CRY2, and among such proteins there are particularly preferred those that are divided into two or more subunits and that allow control of association and dissociation between the subunits by photoirradiation. Examples of optical switch protein genes composed of two or more subunits include the Magnet gene (pMag (SEQ ID NO: 1)-nMagHigh (SEQ ID NO: 2), the Dronpa gene (DPK (SEQ ID NO: 3)-DPN (SEQ ID NO: 4)) (NPL 16: X. X. Zhou, K. Chung, A. J. Lam and M. Z. Lin, Science, 338, 810-814 (2012)), and the Cry2 (SEQ ID NO: 5)-CIB1N (SEQ ID NO: 6) system, as well as their modified genes, but it is not intended to be limited thereto. Magnet gene (pMag-nMag) is preferred from the viewpoint of incorporation into the L gene.

The wavelength of the irradiated light may be selected as appropriate according to the type of optical switch protein used. This may be a wavelength of 450 to 490 nm when the Magnet gene (pMag-nMag) is used, 390 to 500 nm when the Dronpa gene (DPK-DPN) is used, or 450 to 490 nm when the Cry2-CIB1N gene is used. A wavelength with high permeability in the body is preferred from the viewpoint of off/on control of the optical switch protein in vivo, with wavelengths of 450 to 900 nm being preferred and wavelengths of 650 to 900 nm being more preferred. The optical switch protein may be modified as desired to alter the sensitive wavelength range. A person skilled in the art can thus modify a known optical switch protein so as to have the preferred absorption wavelength depending on the mode of use of the present invention.

An optical switch protein composed of two or more subunits will usually have a property such that the independent free subunits associate under irradiation of light of a specific wavelength. A system has been proposed in which this property is utilized, combining an optical switch protein with a Cre-loxP system to allow control of DNA recombinant reaction by light (NPL 8: Nature Chemical Biology, DOI10.1038/nchembio.2205). Specifically, it is a system in which the DNA recombinant enzyme Cre is split in two and the optical switch protein Magnet gene subunits (pMag and nMag) are linked at the N-terminal end (CreN) and C-terminal end (CreC), respectively, and independently expressed. CreN-pMag and CreC-nMag are each present as free subunits under no light irradiation, but under blue light irradiation the pMag and nMag associate and the enzyme activity of Cre is exhibited. A similar system has been proposed in which the optical switch protein Magnet gene is combined with a Crisper-Cas9 system to allow control of DNA recombination reaction with light (NPL 9: Nature Biotechnology 33, 755-760(2015) doi:10.1038/nbt.3245). The pMag subunit (SEQ ID NO: 1) and nMag subunit (SEQ ID NO: 7) used as Magnet genes have the amino acid sequence listed as SEQ ID NO: 1 and the amino acid sequence listed as SEQ ID NO: 2, respectively, and are expressed as free proteins and associate under blue light irradiation. Modified genes with different association rates are known, and such modified Magnet genes may also be used. The genes pMagFast1 (SEQ ID NO: 76) and pMagFast2 (SEQ ID NO: 77) are known as modified forms of the pMag subunit (SEQ ID NO: 1). Also, the gene nMagHigh (SEQ ID NO: 2) is known as a modified form of the nMag subunit (SEQ ID NO: 7).

According to the invention, in an optical switch protein composed of two or more subunits, the subunits are linked together with a linker. If the number of subunits is represented as n, then n−1 linkers are present between the subunits. The length of each linker can be selected as desired from the viewpoint of exhibiting the function of the optical switch gene and exhibiting the function of the virus protein. Once the optical switch gene has been incorporated into the exogenous gene-transferable region, assuming that virus rescue is possible, then the function of the optical switch gene can be regulated by adjusting the number of linker residues. The reason is that virus rescue ability allows the subunits of the optical switch protein to associate under light irradiation, the virus protein activity being maintained in the associated state and the linker length being unlikely to affect the state of association, whereas in the unassociated state (under no light irradiation), progressive lengthening of the linker allows the activity of virus protein to be lowered at some length.

The upper limit for the number of linker residues may be selected as appropriate depending on the upper limit for the size of the transgene in the exogenous gene-transferable region, and the sizes of the subunits of the optical switch protein, and for example, it is preferably no greater than 100 residues, more preferably no greater than 50 residues and even more preferably no greater than 30 residues. The lower limit for the number of linker residues is preferably at least 10 residues, more preferably at least 15 residues and even more preferably at least 20 residues, from the viewpoint of acceptable freedom and association of the subunits. The linker sequences may be any desired sequences, but preferably they do not adopt secondary structures such as a β-sheet or α-helix. Therefore, the glycine content in the linkers is preferably 25% or higher, more preferably 40% or higher and even more preferably 50% or higher.

The optical switch protein and virus protein may be linked together with a linker, or they may be directly linked together. The linker between the N-terminal subunit and the virus protein will be referred to as the N-linker (or upstream linker), and the linker between the C-terminal subunit and virus protein may be referred to as the C-linker (or downstream linker). The upper and lower limits for the N-linker and C-linker residues may be selected as appropriate depending on the upper limit for the transgene size, and the sizes of the subunits of the optical switch protein to be introduced. For example, it may be no greater than 50 residues, more preferably no greater than 30 residues and even more preferably no greater than 15 residues. A tag may also be included, either instead of a linker or together with a linker, in order to detect whether or not the exogenous gene has been properly transferred.

One aspect of the invention relates to a nucleic acid encoding a virus protein gene in which a gene coding for an optical switch protein according to the invention has been inserted in an expressible manner. The "nucleic acid encoding a gene" includes, in addition to the original nucleic acid sequence, also nucleic acids coding for the same gene due to degeneracy. Another aspect of the invention relates to a plasmid vector or virus vector that includes the aforementioned nucleic acid.

The virus vector of the invention may also include nucleic acid encoding arbitrary exogenous genes in addition to the nucleic acid encoding the virus gene. Since the virus vector of the invention allows local activation of the virus vector by irradiation of light, it is possible to activate the virus vector in a site-specific manner by light irradiation causing expression of the exogenous gene, after administration of the virus vector. The light may be irradiated from outside of the body, or an endoscope may be used for irradiation from within the body. Such a virus vector may also be referred to as a "photosensitive virus" vector. The photosensitive virus of the invention can be used for treatment of diseases such as cancer, by utilizing cytolytic properties, and especially the oncolytic activity of the virus. After infection with the photosensitive virus, light may be irradiated onto the target cells, and particularly onto the region that includes cancer cells, to cause site-specific cytolysis.

Measles virus can usually incorporate multiple genomes into its particles (NPL 10: Emboj. 2002 May 15, 21(10): 2364-72). It is therefore able to proliferate even when its genome is segmented into 2 or 3 parts (NPL 11: J. Virol. 2006; 80:4242-4248). There is no intended implication, therefore, that the virus vector of the invention is necessarily composed of only a single genome, and depending on the case it may include 2, 3 or more genomes.

The exogenous gene to be transferred into the photosensitive virus vector may be selected as appropriate according to the purpose. For use in gene therapy against cancer, for example, a tumor suppressor gene (such as p53, Rb or RCA1) may be directly transferred into cancer cells, or a gene such as T cell receptor (TCR) may be expressed in lymphocytes to increase the tumor antigen-specific cytotoxicity. Alternatively, as gene transfer therapy for a genetic disease patient having a genetic defect, a gene that can compensate for the genetic defect may be transferred into a virus vector as an exogenous gene. Such genes may be, dystrophin, laminin a2 or dystroglycan, for example, for treatment of muscular dystrophy. A person skilled in the art can appropriately select target diseases and genes to be transferred for treatment thereof.

The virus vector of the invention may also be utilized for research purposes instead of treatment purposes. It is possible to achieve transient expression of an exogenous gene by irradiation of a prescribed type of light after infection of cells with a virus vector of the invention, and to subsequently lower the activity of the virus and eliminate the virus from the cells by ceasing the photoirradiation. For creation of iPS cells it is necessary to cause expression of reprogramming factors such as OCT3/4, SOX2, Klf4 and 1-Myc (or c-Myc) in somatic cells. In previous experiments using virus vectors, it has not been possible to control the activity of the viruses. Therefore, in previous experiments using virus vectors it has not been possible to eliminate the viruses after inducement to iPS cells. In addition, since some introduced factors are also known as oncogenes there is a known risk of canceration of iPS cells. It is possible to transiently express one or more reprogramming factors in cells by utilizing the virus vector of the invention for gene transfer, and then carrying out photoirradiation. Moreover, by ceasing the photoirradiation it is possible to reduce the activity of or to inactivate the virus. This allows the virus to be completely eliminated by repeated subculturing after induction of iPS cells.

Yet another aspect of the invention relates to a method of transiently infecting a virus vector into cells using a photosensitive virus vector of the invention. More specifically, the method includes a step of infecting cells with a photosensitive virus vector of the invention, a step of culturing the infected cells in the presence of light, and a step of culturing the infected cells in the absence of light. By culturing in the presence of light, it is possible to activate the virus vector and to promote gene expression of the transgene. By subsequently culturing in the absence of light it is possible to inactivate the virus and to eliminate the virus. Subculturing may be carried out in a dark environment to completely eliminate the virus. Several generations subculture can completely eliminate viruses.

The method for transient infection of the virus vector may be applied to a method for producing iPS cells. This method includes a step of infecting somatic cells with a photosensitive virus vector of the invention that includes at least one transgenes selected from the group consisting of Oct3/4, Sox2, Klf4, 1-Myc (or c-Myc), Nanog and Lin28, and a step of culturing the infected cells in the presence of light. By culturing in the presence of light, the transgenes are expressed in the cells, and induction to iPS cells takes places when specific combinations, such as Oct3/4, Sox2, Klf4, and 1-Myc or Oct3/4, Nanog and Lin28, are expressed. A step of further culturing the induced iPS cells in the absence of light may also be carried out. This step results in inactivation of the virus vector that has infected the iPS cells. Subculturing may be carried out in a dark environment in order to completely eliminate the virus vector. Subculturing for several generations can completely eliminate the virus vector. This allows transgene-free iPS cells to be created. Transgene-free iPS cells are iPS cells or their progeny cells that contain substantially none of the transgene that has been transferred for induction to iPS cells, or of the virus vector used for introduction of the transgene. The phrase "contain substantially none of the virus vector" means that the virus vector is undetected when its presence is confirmed by an RT-PCR method, for example.

All of the publications mentioned throughout the present specification are incorporated herein in their entirety by reference.

The examples of the invention described below are intended to serve merely as illustration and do not limit the technical scope of the invention. The technical scope of the invention is limited solely by the description in the Claims. Modifications of the invention, such as additions, deletions or substitutions to the constituent features of the invention, are possible so long as the gist of the invention is maintained.

Example 1: Preparation of Optical Switch Protein-Transferred Virus

Preparation of Plasmid for Formation of Recombinant Measles Virus

A plasmid for formation of recombinant measles virus was prepared based on plasmid p(+)MV323 that codes for the genomic sequence of measles virus strain IC-B. An EGFP transcription unit was added at the head of the genome of the measles virus (FIG. 1) (SEQ ID NO: 8). This made it possible to confirm cells infected with the virus based on EGFP expression. A modified L protein gene was produced by introducing the genes selected from DP (SEQ ID NO: 9), pMag-nMaghigh (SEQ ID NO: 10), CRY2-CIB1N (SEQ ID NO: 11) and CRY2 PHR-CIB1N (SEQ ID NO: 12), as photoresponsive genes, into the exogenous gene-transferable region of the L protein gene. In-fusion kit (Clontech) was used to carry out these gene transfection. The PCR primers used for preparing each plasmid were as follows. The sequences of the gene-introduced plasmids were p(+)MV323-DPK-DPN (SEQ ID NO: 13), p(+)MV323-pMag-nMaghigh (SEQ ID NO: 14), p(+)MV323-CRY2-CIB1N (SEQ ID NO: 15) and p(+)MV323-CRY-PHR-CIB1N (SEQ ID NO: 16).

TABLE 1

| Primer | Sequence |
|---|---|
| EGFP Forward | GGCGCGCCATGGTGAGCAAGGGCGAGGAG (SEQ ID NO: 17) |
| EGFP Reverse | GACGTCTTACTTGTACAGCTCGTCCATGCC (SEQ ID NO: 18) |
| DP Forward 1 | <u>GGTCGGCAGCGACGT</u>CATGGTGAGCGTGATCAAGC (SEQ ID NO: 19) |
| DP Forward 2 | ATGGTGAGCGTGATCAAGCCCG (SEQ ID NO: 20) |
| DP Reverse 1 | GATCACGCTCACCATGGATCCTCCTTGGGTCGATCCTCCT (SEQ ID NO: 21) |
| DP Reverse 2 | CTCATATTTGAGATGACGTCCTTGGCCTGGCGGGGCA (SEQ ID NO: 22) |
| pMagnMaghigh Forward 1 | <u>CAAAGGTCGGCAGCGACGT</u>CAGCCATACTCTTTATGCCCCCGGT (SEQ ID NO: 23) |
| pMagnMaghigh Forward 2 | GGGTGGTAGTGGTGGTTCAGGAGGAGGATCGACCCAAGGAGGATC CATGCATACTCTTTAT (SEQ ID NO: 24) |
| pMagnMaghigh Reverse 1 | CCACCACTACCACCCGATCCTCCGCCGCCGTCAGCGGAATTACCGG TTTCTGTTTCGCACT (SEQ ID NO: 25) |
| pMagnMaghigh Reverse 2 | CCCGCGTAATCTGGGACGTCGTACGGATATTCTGTTTCGCACTGGA ATC (SEQ ID NO: 26) |
| Reverse 3 common to plasmids other than EGFP, DP | CTCATATTTGAGATGCCCGCGTAATCTGGGA (SEQ ID NO: 27) |

TABLE 1-continued

| Primer | Sequence |
|---|---|
| CRY2-CIB1N Forward 1 | CAAAGGTCGGCAGCGACGTCAAGATGGACAAAAAGACTATAGTTT GGT (SEQ ID NO: 28) |
| CRY2-CIB1N Forward 2 | GGGTGGTAGTGGTGGTTCAGGAGGAGGATCGACCCAAGGAGGATC CATGAATGGAGCTATA (SEQ ID NO: 29) |
| CRY2-CIB1N Reverse 1 | CCACCACTACCACCCGATCCTCCGCCGCCGTCAGCGGAATTACCGG TTTTGCAACCATTTTTTC (SEQ ID NO: 30) |
| CRY2-CIB1N Reverse 2 | CCCGCGTAATCTGGGACGTCGTACGGATAGCCAATATAATCCGTTTT CTCCAAT (SEQ ID NO: 31) |
| CRYPHR-CIB1N Forward 1 | Same as CRY2-CIB1N Forward 1 (SEQ ID NO: 28) |
| CRYPHR-CIB1N Forward 2 | Same as CRY2-CIB1N Forward 2 (SEQ ID NO: 29) |
| CRYPHR-CIB1N Reverse 1 | CCACCACTACCACCCGATCCTCCGCCGCCGTCAGCGGAATTACCGG TTGCTGCTCCGATCAT (SEQ ID NO: 32) |
| CRYPHR-CIB1N Reverse 2 | Same as CRY2-CIB1N Reverse 2 (SEQ ID NO: 31) |

Synthesis of Recombinant Measles Virus

BHK/T7-9 cells that had been grown in a 6-well plate were transfected using 0.8 μg of N protein expression plasmid (pCITE-IC-N) (SEQ ID NO: 33), 0.6 μg of P protein expression plasmid (pCITE-IC-PAC) (SEQ ID NO: 34), 1.6 μg of L protein expression plasmid (pCITE-9301B-wtL) (SEQ ID NO: 35) and the plasmid for formation of the recombinant measles virus (5 μg), using an X-tremeGENE HP (Roche). After culturing for 2 days, the BHK/T7-9 cells were overlaid onto Vero/hSLAM cells and examined for the presence or absence of virus rescue.

Figure 4:
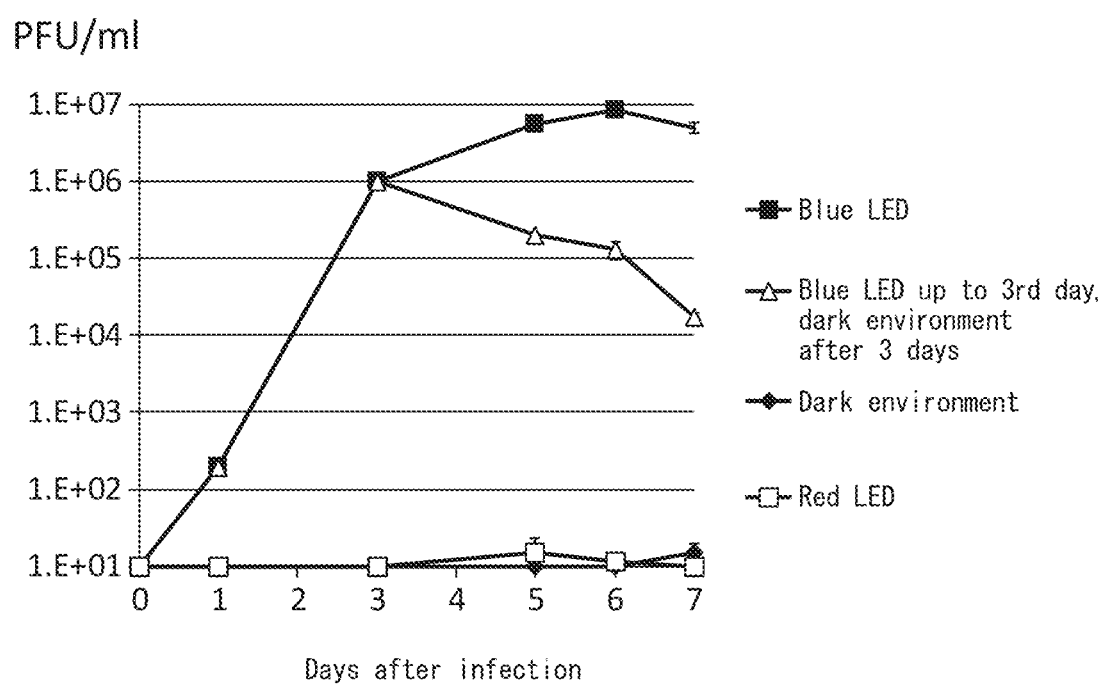
Figure 5:
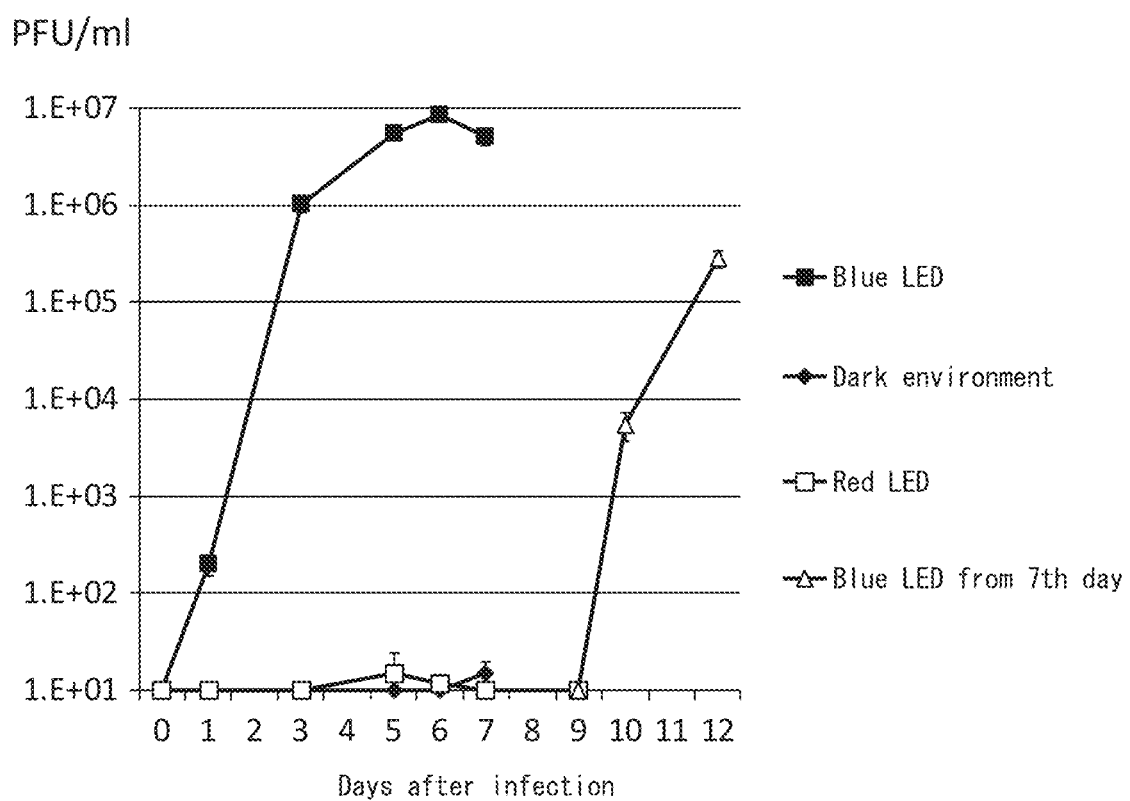

TABLE 2

| Name | L gene structure | Amino acid sequence | Amino acid size of transferred sequence | Virus rescue |
|---|---|---|---|---|
| Wild L protein | Ln-Lc | SEQ ID NO: 36 | — | Yes |
| EGFP | Ln-EGFP-Lc | SEQ ID NO: 37 | 244 residues | Yes |
| DP | Ln-DPK-DPN-Lc | SEQ ID NO: 38 | 480 residues | Yes |
| pMagnMaghigh | Ln-pMag-nMaghigh-Lc | SEQ ID NO: 39 | 340 residues | Yes |
| CRY2-N | Ln-CRY2-CIB1N-Lc | SEQ ID NO: 40 | 820 residues | Yes |
| PHR-N | Ln-CRY2PHR-CIB1N-Lc | SEQ ID NO: 41 | 706 residues | Yes |

Confirmation of Photoresponsiveness

The rescued recombinant measles virus was infected into Vero/hSLAM cells to an MOI of 0.01. After infection, the cells infected with the measles virus incorporating the photoresponsive genes were cultured separately as a blue LED (peak wavelength: 470 nm blue)-irradiated group, a dark environment group, and a red LED (peak wavelength: 655 nm)-irradiated group, and the presence or absence of EGFP expression was examined. When pMag-nMaghigh was introduced as the optical switch protein, EGFP expression was seen in the blue LED-irradiated group but EGFP expression in the dark environment group was low (FIG. 2). This photoresponsive virus will hereunder be referred to as "Magnet-L photosensitive measles virus".

Example 2: Control of Photosensitive Measles Virus by Photoirradiation

Growth Curve of Photosensitive Measles Virus

Vero/hSLAM cells that has been grown in a 6-well plate were infected with the Magnet-L photosensitive measles virus obtained in Example 1 to an MOI of 0.01. For exposure to blue or red LED, they were cultured in a $CO_2$ incubator while irradiating with LEDs of each color (peak wavelengths: 655 nm red, 470 nm blue), using an ISLM-150×150-RB (CCS). The cells and culture solution were recovered at different time points, and the infection titer (PFU) of the proliferated virus was measured (FIG. 3). Virus proliferation was confirmed only in the blue LED-irradiated group (FIG. 3). Even with examination of EGFP fluorescence with a fluorescent microscope, it was confirmed that the virus had proliferated in a manner dependent on blue LED irradiation (FIG. 2). The same experiment was conducted, ceasing blue LED irradiation from the 4th day in a portion of the blue LED-irradiated group, and the change in virus proliferation was observed (FIG. 4). When blue LED irradiation was stopped, the virus proliferation halted and the titer gradually reduced (FIG. 4). The same experiment was conducted with dark environment culturing of Vero/hSLAM cells infected with Magnet-L photosensitive measles virus for 7 days, and with blue LED irradiation initiated from the 7th day. Virus proliferation began after blue LED irradiation was initiated, with a high virus titer being confirmed from the 10th day onward (FIG. 5).

Example 3: Mini-Genome Assay

Creation of Measles Virus Mini-Genome Expression Plasmid

Figure 6:
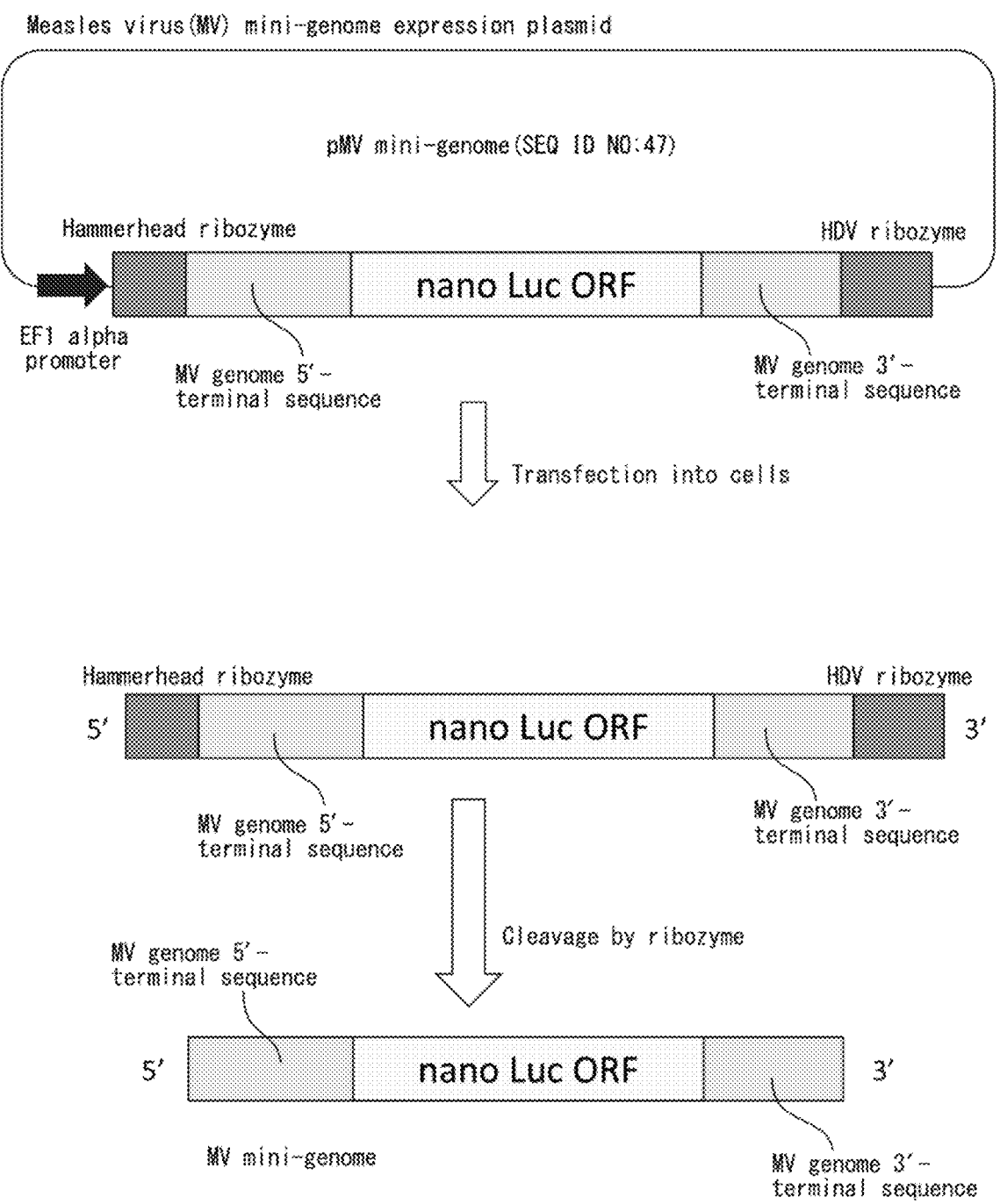

A measles virus mini-genome expression plasmid (SEQ ID NO: 47) was created, having the CMV promoter region of pcDNA3 (Thermo Fisher Scientific) replaced with the EF1 alpha promoter sequence of pEF-DEST51 (Thermo Fisher Scientific), and with a hammerhead ribozyme sequence (SEQ ID NO: 42), a measles virus genome 5'-terminal sequence (SEQ ID NO: 43), a nano luc gene sequence (from pNL3.3, Promega) (SEQ ID NO: 44), a measles virus genome 3'-terminal sequence (SEQ ID NO: 45) and an HDV ribozyme sequence (SEQ ID NO: 46) incorporated downstream from the EF1 alpha promoter sequence (FIG. 6). When this measles virus mini-genome expression plasmid is transfected into cells, the action of the EF1 alpha promoter causes transcription of RNA having the hammerhead ribozyme at the 5'-end and the HDV ribozyme at the 3'-end. The action of these ribozymes results in cleavage of the transcribed RNA ribozyme portions, forming a measles virus mini-genome with the nano Luc gene, simulating the measles virus genome (FIG. 6).

Creation of Measles Virus Protein Expression Plasmid: Mini-Genome Assay

The N gene sequence of measles virus strain IC-B was introduced downstream from the CAG promoter of pCA7 plasmid (same as pCAG-T7 plasmid), to obtain an N protein expression plasmid (pCA7-IC-N: SEQ ID NO: 48). Similarly, the P gene sequence of measles virus strain IC-B was introduced downstream from the CAG promoter of pCA7 plasmid to obtain a P protein expression plasmid (pCA7-IC-PAC: SEQ ID NO: 49). In addition, the L gene sequence of measles virus strain 9301B was introduced downstream from the CAG promoter of pCA7 plasmid to obtain an L protein expression plasmid (pCA7-9301B-wtL: SEQ ID NO: 50). These plasmids were obtained as described in NPL 12 (Takeda et al. 2005 Virus Res 108:161-165) and NPL 13 (Nakatsu et al. 2006 J Virological Methods 137:152-155). A modified L protein expression plasmid (SEQ ID NO: 51) was also obtained in the same manner as above, but based on the aforementioned modified L protein gene of p(+) MV323-pMagnMaghigh (SEQ ID NO: 14) instead of the L gene sequence.

Mini-Genome Assay

Figure 7:
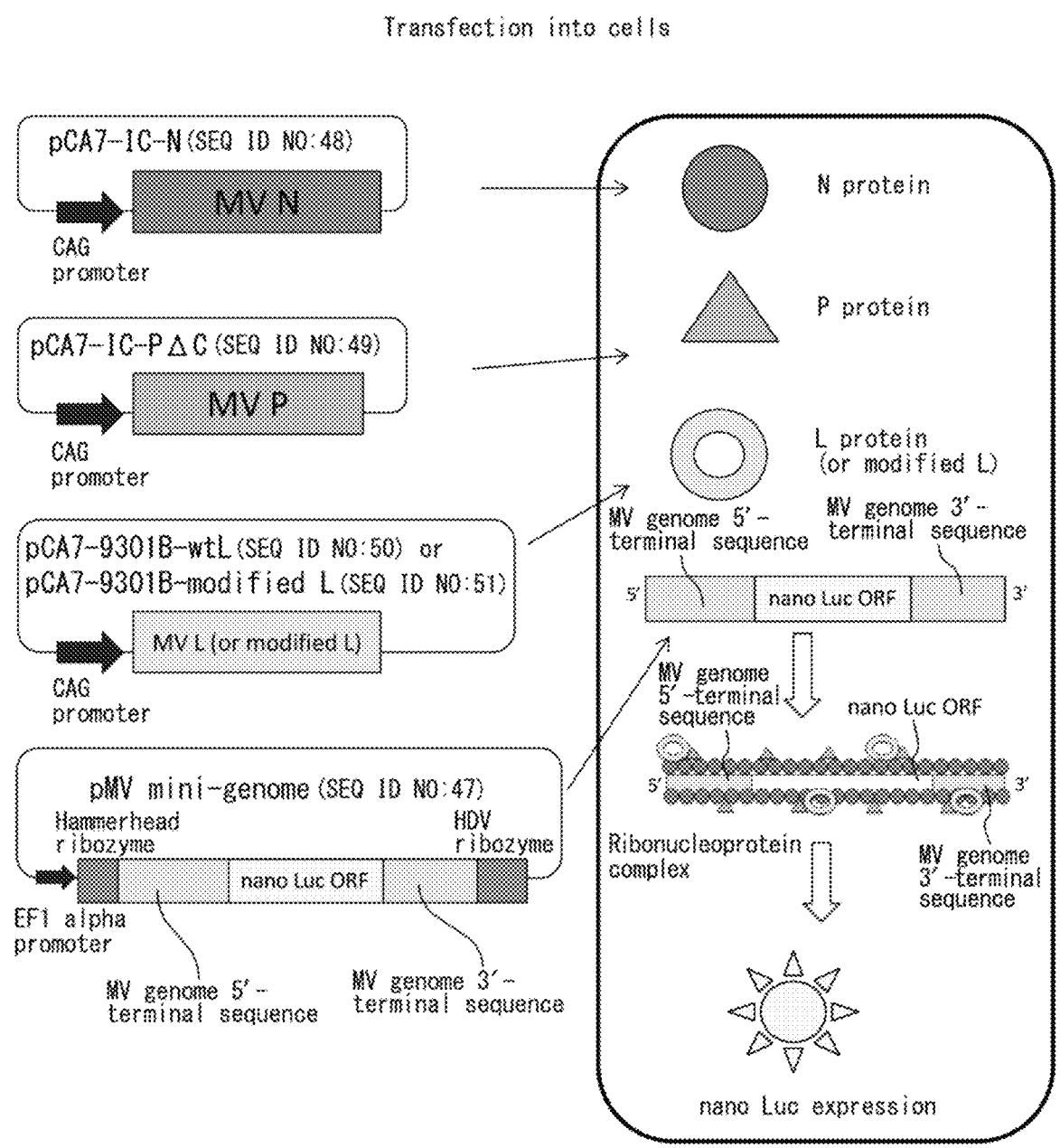
Figure 8:
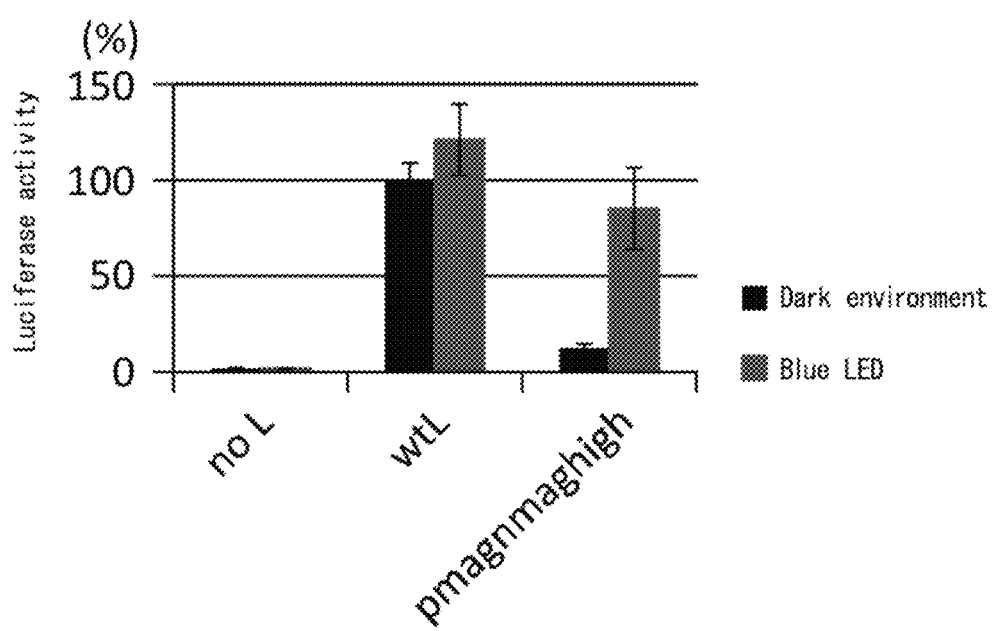

The measles virus mini-genome expression plasmid (0.03 the N protein expression plasmid (0.06 μg), the P protein expression plasmid (0.015 μg) and the L protein expression plasmid or modified L protein expression plasmid (0.06 μg) were transfected into 293T cells that had been seeded into a 96-well plate, using TransIT LT1 (Mirus). When the measles virus mini-genome has been produced in the transfected cells, and N protein, P protein and L protein (or modified L protein) are expressed and all them are brought together, a ribonucleoprotein complex forms (FIG. 7). With the ribonucleoprotein complex, the nano Luc gene is transcribed and nano Luc is expressed by the translation system in the cells by the RNA-dependent RNA polymerase activity of L protein (FIG. 7). After 2 days of culturing of the transfected cells in a dark environment or under light irradiation of a prescribed wavelength (blue LED irradiation (470 nm)), 10 μl of culture supernatant was collected and the luciferase activity was measured with a Nano-Glo Luciferase Assay Kit (Promega). The results are shown in FIG. 8. In FIG. 8, luciferase activity in a dark environment is shown as 100%, for expression of the wild type L protein. In the cell group that had expressed the L protein incorporating pMag, nMaghigh and a linker sequence (pMag-nMaghigh), a notable reduction in luciferase activity was observed in a dark environment (dark), whereas luciferase activity could be detected with blue LED irradiation (blue) (FIG. 8). As demonstrated by Example 2, the Magnet-L photosensitive measles virus having the modified L protein incorporating pMag, nMaghigh and a linker sequence (pMag-nMaghigh) allows its activity to be controlled by irradiation of blue light. In the mini-genome assay of this experiment as well, optical control of the modified L protein was shown to be possible, demonstrating that this mini-genome assay can be used as a substitute for an actual experiment using viruses.

Example 4: Examination of Linkers

Figure 9:
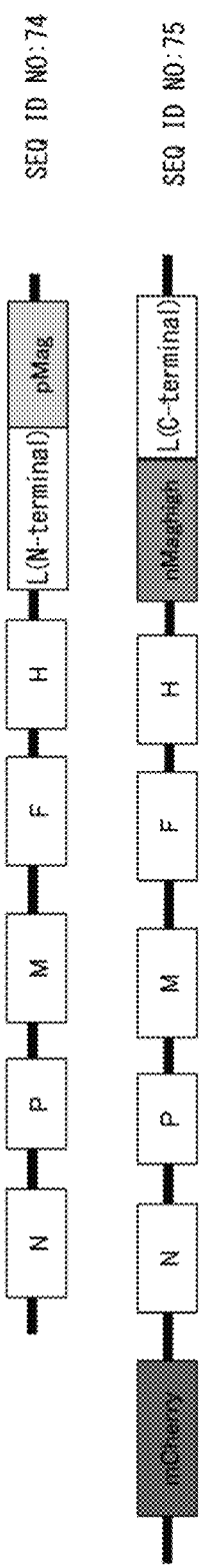

A test was conducted to determine whether an optically controlled measles virus can be synthesized by making use of two measles virus genomes, with pMag and nMaghigh and without a linker. Specifically, virus vectors were created having the N-terminal end of the L gene and pMag linked at the L gene of one genome, and the nMaghigh gene and the C-terminal end of the L gene linked at the L gene of the other genome (SEQ ID NO: 74 and 75; FIG. 9). It was possible that the active form of L protein would be produced as pMag and nMaghigh associated when these virus vectors were coinfected into cells, transcribed and translated and then irradiated with blue light, but in actuality virus rescue was not possible. It is believed that the active form of L protein could not form in the absence of a linker even with blue light irradiation, whereas linking pMag and nMaghigh in one protein via a linker allowed the activity to be controlled by the presence or absence of blue light irradiation.

TABLE 3

| Name | L gene structure | Sequence | Amino acid size of transferred sequence | Irradiated light |
| --- | --- | --- | --- | --- |
| pCA7-9301B-wt L | Ln-Lc | SEQ ID NO: 50 | — | — |
| pCA7-9301B-L-pMag-nMaghigh | Ln-pMag-nMaghigh-Lc | SEQ ID NO: 51 | 340 residues | Blue light |

Virus rescue was possible in Example 1, but it is also possible to examine linkers for the modified L protein that did not exhibit photoresponsiveness. When virus rescue is possible, it allows the subunits of the switch protein to associate under light irradiation and the virus protein activity to be maintained in the associated state, with the linker length being unlikely to affect the state of association, whereas in the unassociated state, progressive lengthening of the linker allows the activity of the virus protein to be lowered at some point. Consequently, photoresponsiveness can be achieved by using a longer linker than the currently used linkers.

Figure 10:
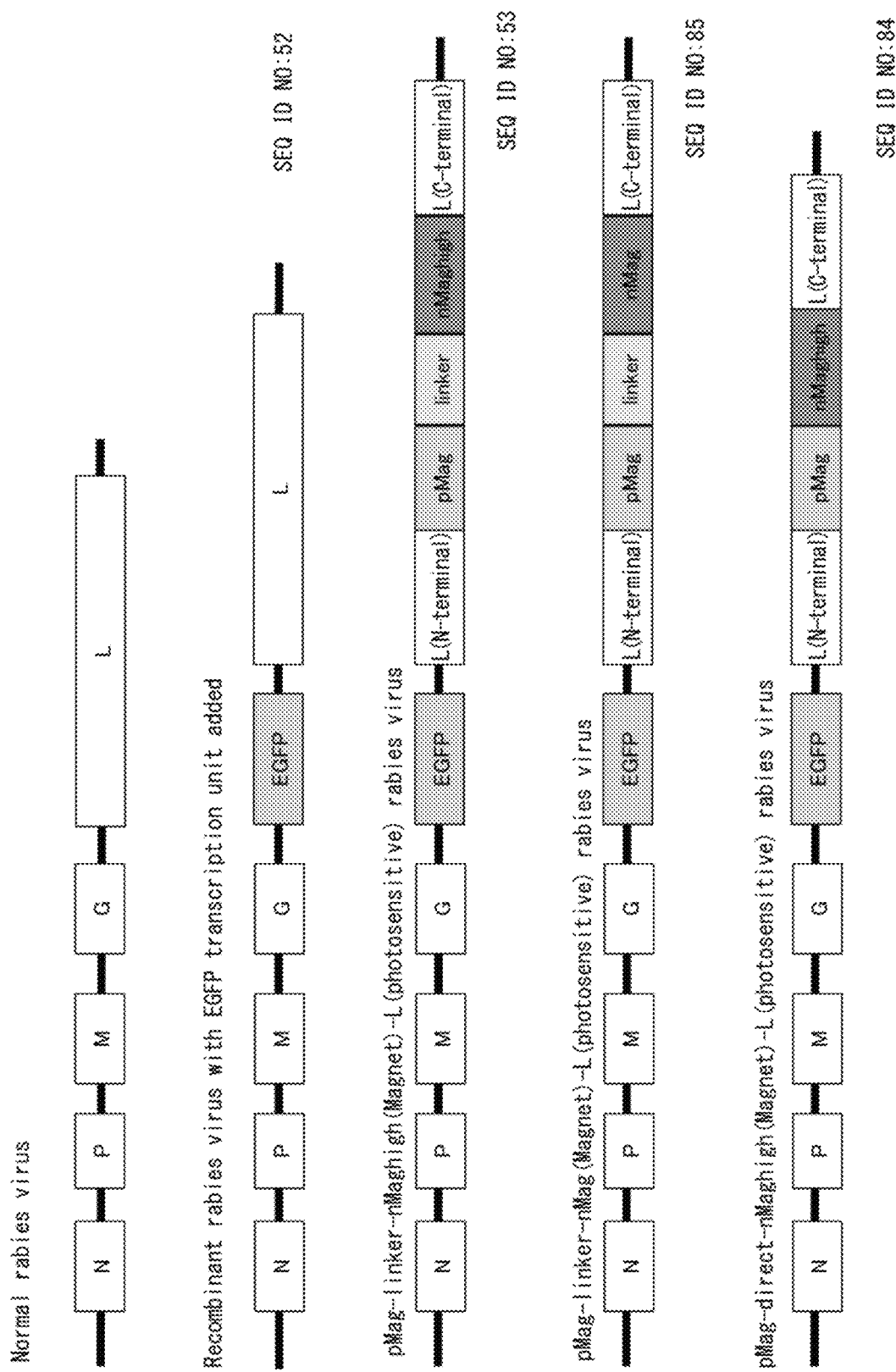
Figure 12:
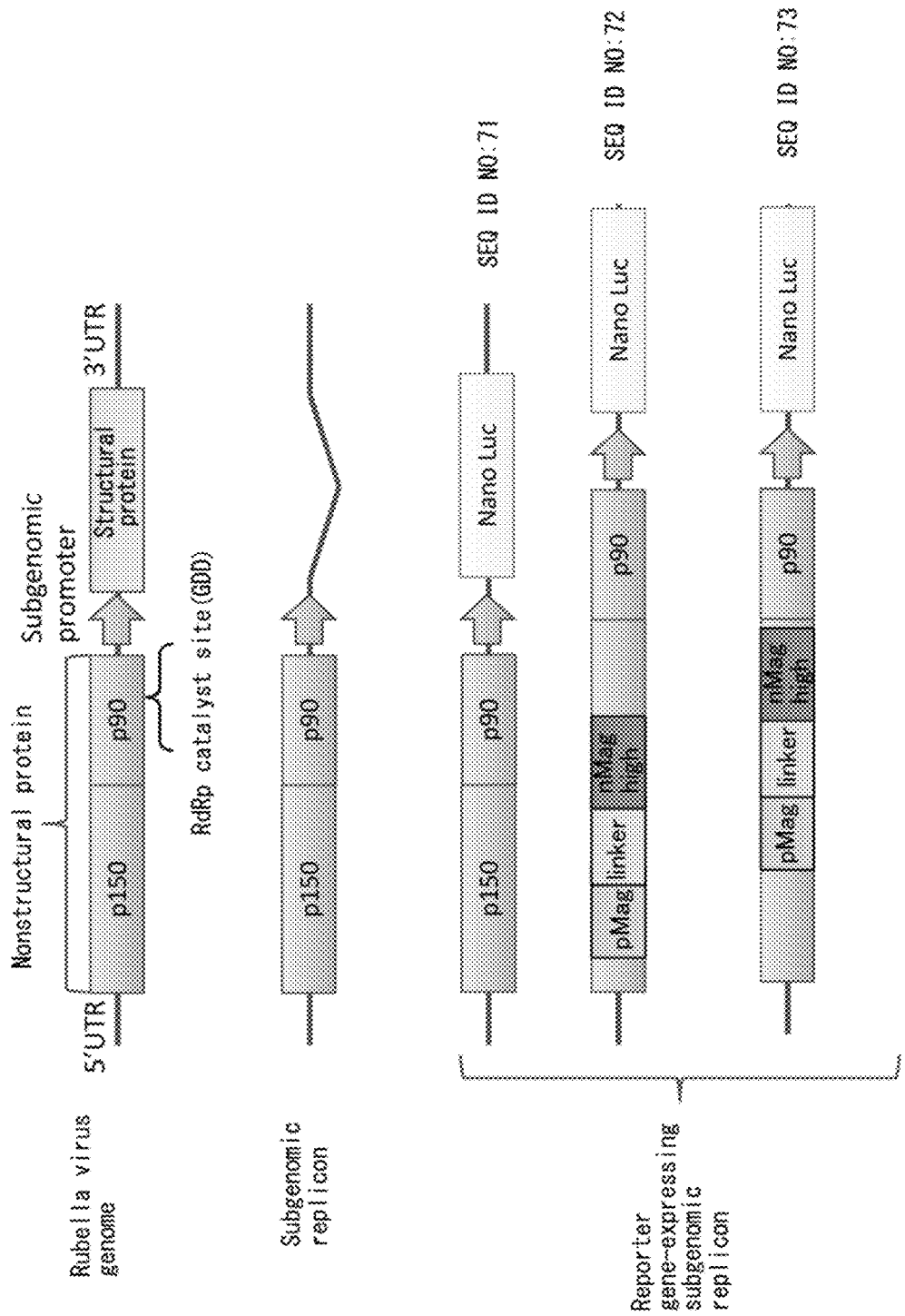
Figure 13:
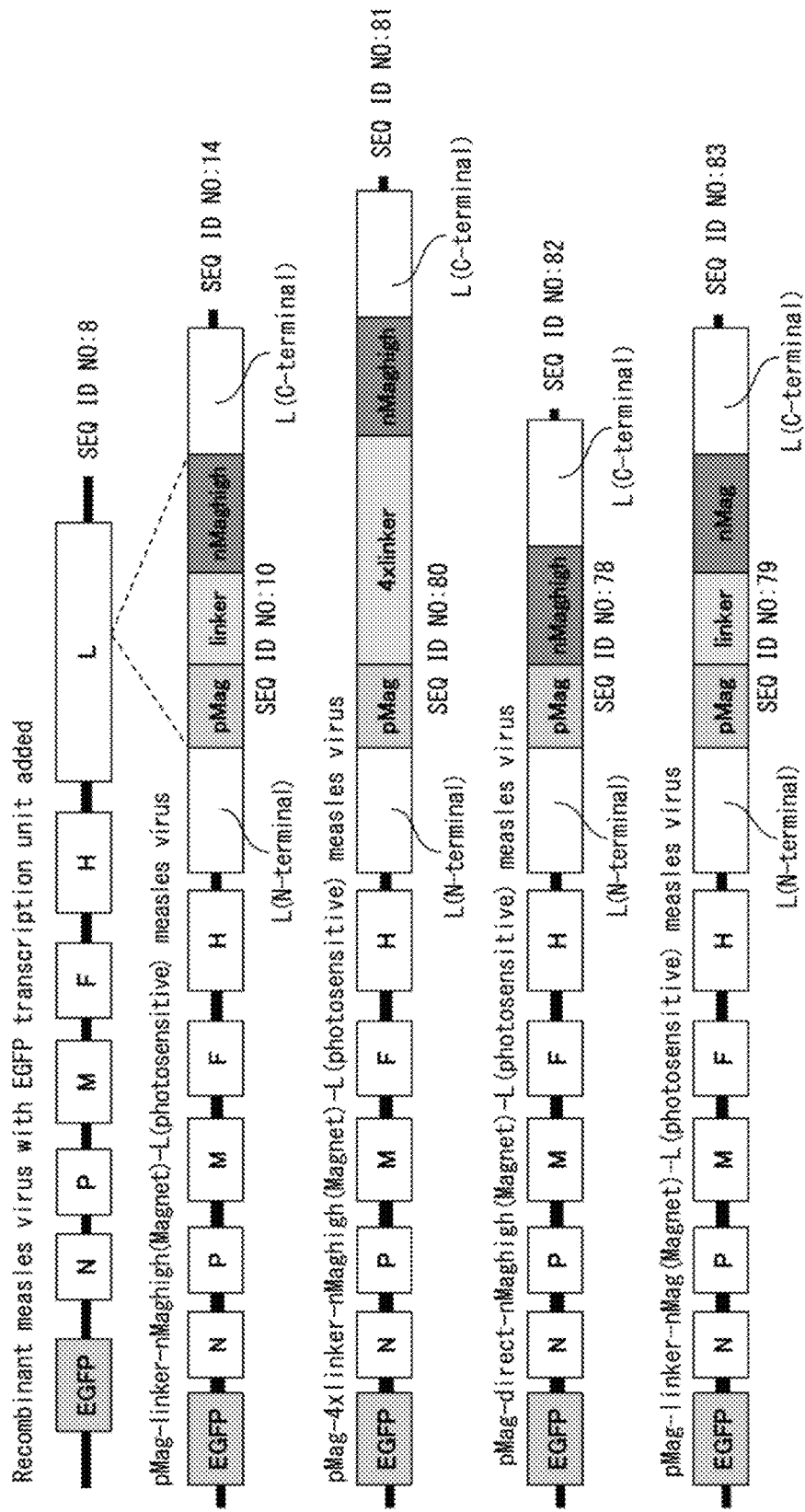

Example 5: Creation of Optically Controllable Virus Vector Based on Rabies Virus Creation of Plasmids for Formation of Recombinant Rabies Virus Plasmids for formation of a recombinant rabies virus were created based on plasmid pHEP that encodes the genomic sequence of rabies virus strain HEP-Flury. An EGFP transcription unit was added between the G gene and L gene in the genome of rabies virus (FIG. 10) (SEQ ID NO: 52). This allows cells infected with the virus to be confirmed based on EGFP expression. This plasmid was obtained according to NPL 14 (Khawplod et al. 2005 Journal of Virological methods 125:35-40). A photoresponsive gene was transferred into the exogenous gene-transferable region of the L gene. As the photoresponsive gene to be transferred, a modified L gene was prepared using pMag-linker-nMaghigh linked using a 26-residue linker (SEQ ID NO: 10), pMag-direct-nMaghigh directly linked without a linker (SEQ ID NO: 78), and pMag-linker-nMag using nMag instead of nMaghigh (SEQ ID NO: 79). Transfer of these genes was carried out using an In-fusion kit (Clontech). The PCR primers used for creation of the plasmids were the following. The sequences of the plasmids in which the genes were transferred were pHEP-pMag-linker-nMaghigh (SEQ ID NO: 53), pHEP-pMag-direct-nMaghigh (SEQ ID NO: 84) and pHEP-pMag-linker-nMag (SEQ ID NO: 85).

TABLE 4

| Primer | Sequence |
| --- | --- |
| Forward 1 | TGTTACCTCCAACACGTGCTACG (SEQ ID NO: 54) |
| Forward 2 | CAACAAGCTTAAGagcCATACTCTTTATGCCCCCG (SEQ ID NO: 55) |
| Forward 3 | cgGGCCTTAAGGTATCTCGCAAGGCAGGAT (SEQ ID NO: 56) |
| Reverse 1 | CTCTTAAGCTTGTTGGGGCTGTAATCTC (SEQ ID NO: 57) |
| Reverse 2 | ATACCTTAAGGCCCGCGTAATCTGGGAC (SEQ ID NO: 58) |
| Reverse 3 | ATGCCCAGGTCGGACCG (SEQ ID NO: 59) |

Synthesis of Recombinant Rabies Virus

BHK/T7-9 cells that had been grown on a 6-well plate were transfected using 0.8 µg of N protein expression plasmid (pH-N) (SEQ ID NO: 60), 0.6 µg of P protein expression plasmid (pH-P) (SEQ ID NO: 61), 1.6 µg of L protein expression plasmid (pH-L) (SEQ ID NO: 62), and 0.5 µg of G protein expression plasmid (pH-G) (SEQ ID NO: 63), and the aforementioned plasmids pHEP-pMag-linker-nMaghigh (SEQ ID NO: 53), pHEP-pMag-direct-nMaghigh (SEQ ID NO: 84) and pHEP-pMag-linker-nMag (SEQ ID NO: 85) (5 µg) for formation of the recombinant rabies virus, using an X-tremeGENE HP (Roche). The BHK/T7-9 cells were continuously cultured with subculturing to obtain the virus.

Confirmation of Photoresponsiveness

Figure 15:
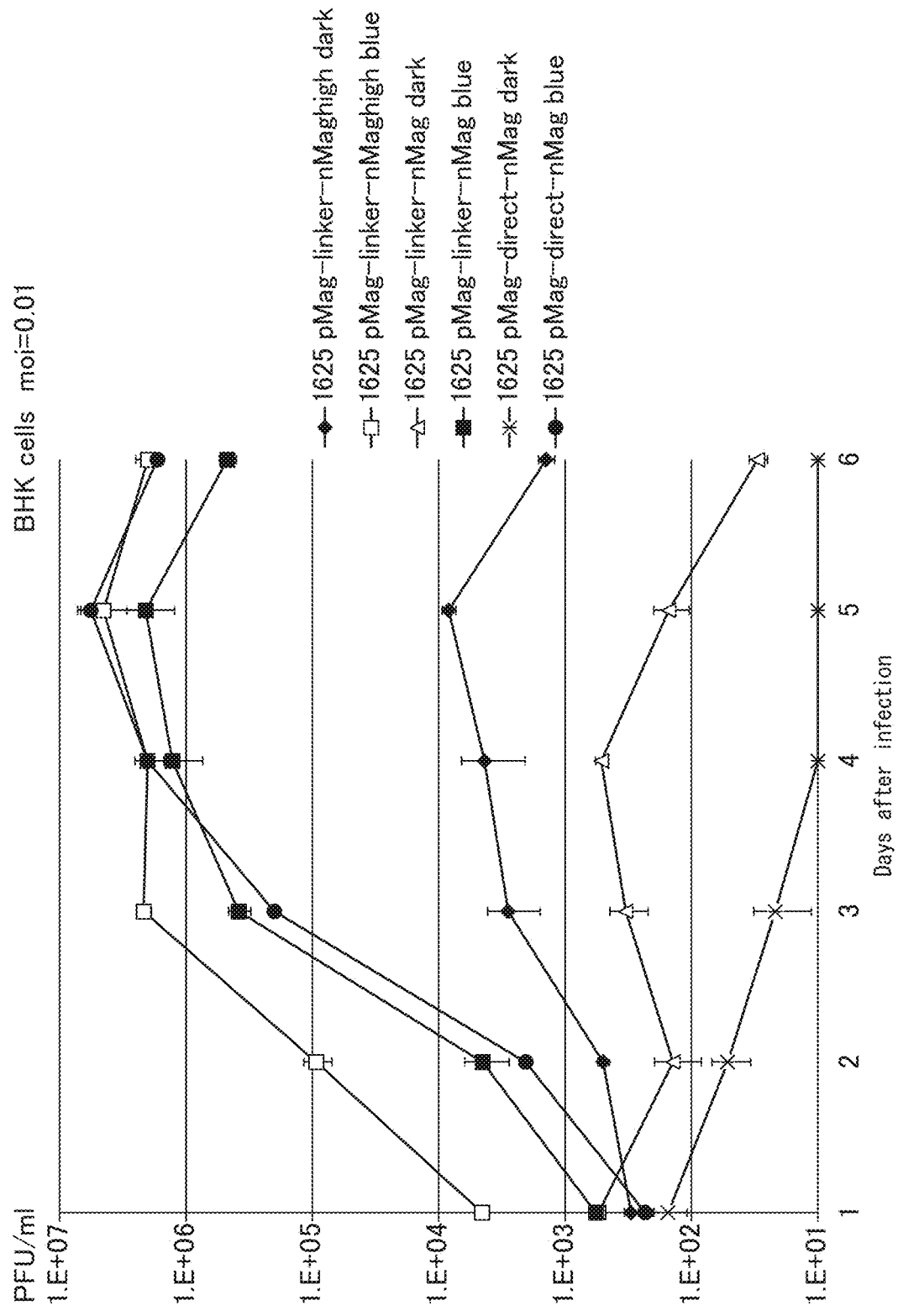

The rescued recombinant rabies virus was infected into BHK cells to an MOI of 0.01. After infection, the cells infected with the rabies virus incorporating the photoresponsive genes were cultured separately as a blue LED (peak wavelength: 470 nm blue)-irradiated group and a dark environment group, and the presence or absence of EGFP expression was examined. With blue LED irradiation, the viruses in which pMag-linker-nMaghigh (SEQ ID NO: 10), pMag-direct-nMaghigh (SEQ ID NO: 78) and pMag-linker-nMag (SEQ ID NO: 79) had been transferred as photoresponsive genes all proliferated to a similar degree. In the dark environment group, however, virus proliferation activity was shown to be inhibited in the order pMag-linker-nMaghigh (SEQ ID NO: 10), pMag-linker-nMag (SEQ ID NO: 79), pMag-direct-nMaghigh (SEQ ID NO: 78) (FIG. 15).

Example 6: Creation of Optically Controllable Virus Vector Based on Rubella Virus Creation of Plasmids for Formation of Recombinant Rubella Virus Plasmids for formation of recombinant rubella virus were created based on plasmid pHS that codes for the genomic sequence of rubella virus strain Hiroshima. Azami Green 1 (AG1) (MBL) is inserted into the exogenous gene-transferable region at amino acid No. 717 within the P150 gene of the rubella virus genome (FIG. 11) (SEQ ID NO: 64). This plasmid was obtained according to NPL 15 (Sakata et al. 2014 Journal of Virology 88:11187-11198). This allows cells infected with the virus to be confirmed based on AG1 expression. In one exogenous gene-transferable region (amino acid No. 1005) present within the P150 gene, the pMag-nMaghigh (SEQ ID NO: 10) gene is transferred to produce a modified P150 gene. Transfer of these genes is carried out using an In-fusion kit (Clontech). The PCR primers used for creation of each plasmids are the following. The sequence of the plasmid into which the genes are transferred is designated as pHS-717AG1-1005 pMag-nMaghigh (SEQ ID NO: 65). Plasmid pHS-717 pMag-nMaghigh-1005AG1 (SEQ ID NO: 66) is also created, with the AG1 and pMag-nMaghigh sites switched.

TABLE 5

| Primer | Sequence |
| --- | --- |
| 717Forward | CGGCCAGTCCaagcttagcCATACTCTTTATGCCCCCGGT (SEQ ID NO: 67) |
| 1005Forward | TTGCCCCGCCaagcttagcCATACTCTTTATGCCCCCGGT (SEQ ID NO: 68) |
| 717Reverse | ACGTGGCCGCAAGCTTGCCCGCGTAATCTGGGACG (SEQ ID NO: 69) |
| 1005Reverse | CCGGGTCGCCAAGCTTGCCCGCGTAATCTGGGAC (SEQ ID NO: 70) |

Synthesis of Recombinant Rubella Virus

This plasmid is used as template to synthesize RNA using an in vitro transcription kit (Life Technologies). BHK cells that have been grown on a 6-well plate are transfected with 2.5 µg of RNA using a DMRIE-C (Life Technologies). The BHK cells are continuously cultured with subculturing to obtain the virus.

Replicon Assay

Creation of Rubella Virus Replicon Expression Plasmid

Figure 11:
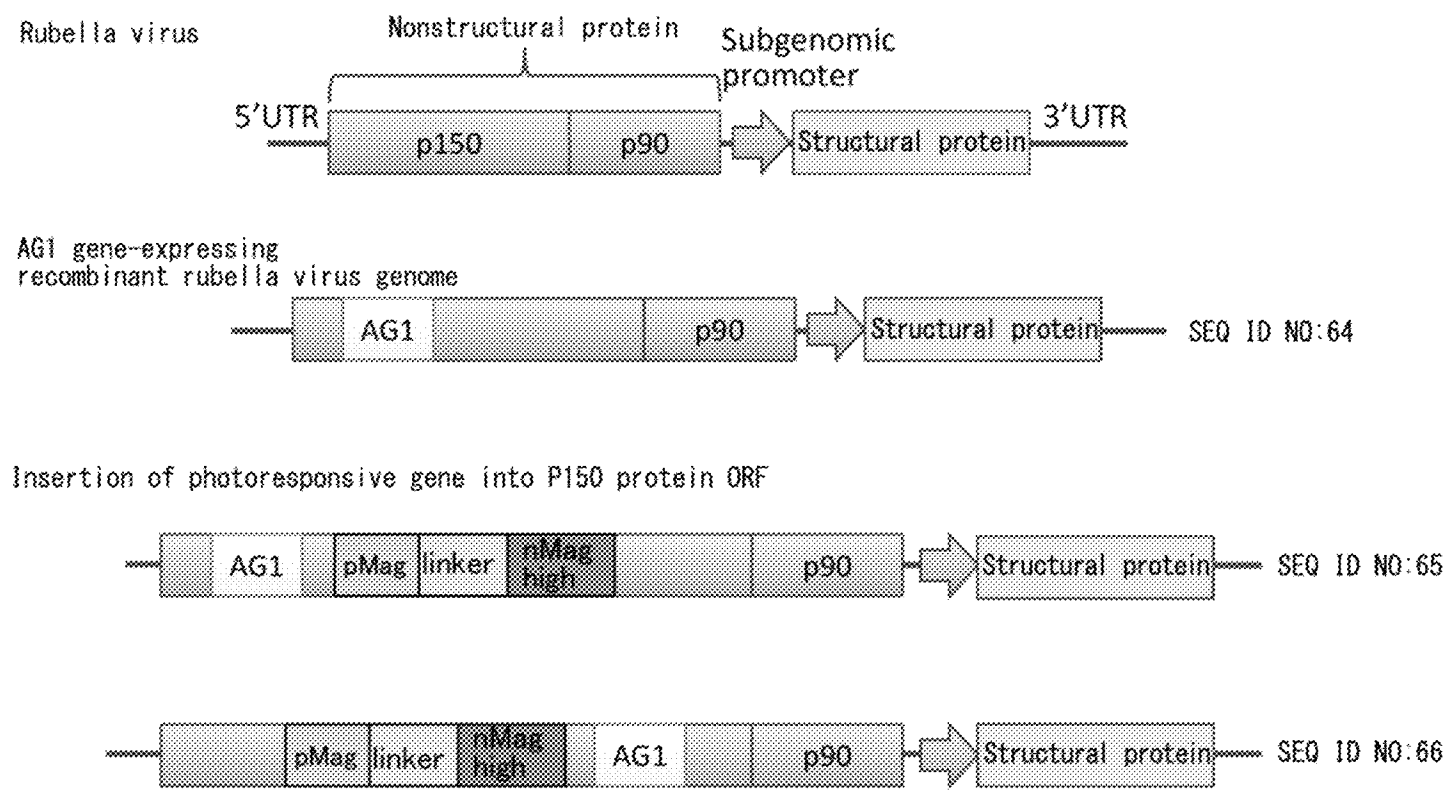

Having prepared a plasmid cloning the genome from rubella virus strain Hiroshima with the ORF coding for structural proteins (C, E2 and E1) deleted (subgenomic replicon), the nano Luc gene was transferred into the structural protein-deleted region of the plasmid (SEQ ID NO: 71) (FIG. 11). This plasmid has the Renilla luciferase gene portion of the plasmid described in NPL 15 (Sakata et al. 2014 Journal of Virology 88:11187-11198), replaced with the nano Luc gene. The pMag-nMaghigh gene was transferred into two different exogenous gene-transferable regions of the P150 sequence (amino acid No. 717 and amino acid No. 1005), to obtain modified P150 protein (modified L)-expressing replicons (SEQ ID NO: 72 and SEQ ID NO: 73).

TABLE 6

| Name | Plasmid sequence |
| --- | --- |
| wtP150 | SEQ ID NO: 71 |
| P150-717pmag-nMaghigh | SEQ ID NO: 72 |
| P150-1005pmag-nMaghigh | SEQ ID NO: 73 |

Replicon Assay

This replicon plasmid is used as template to synthesize RNA using an in vitro transcription kit (Life Technologies). BHK cells that have been grown on a 24-well plate are transfected with 1.5 µg of replicon RNA and 1.5 µg of rubella virus capsid RNA using a DMRIE-C (Life Technologies). P150 protein and P90 protein are expressed in the transfected cells, and the polymerase activity of these proteins results in transcription of the nano Luc gene and expression of nano Luc by translation in the cells.

Example 7: Preparation of iPS Cells

Figure 17:
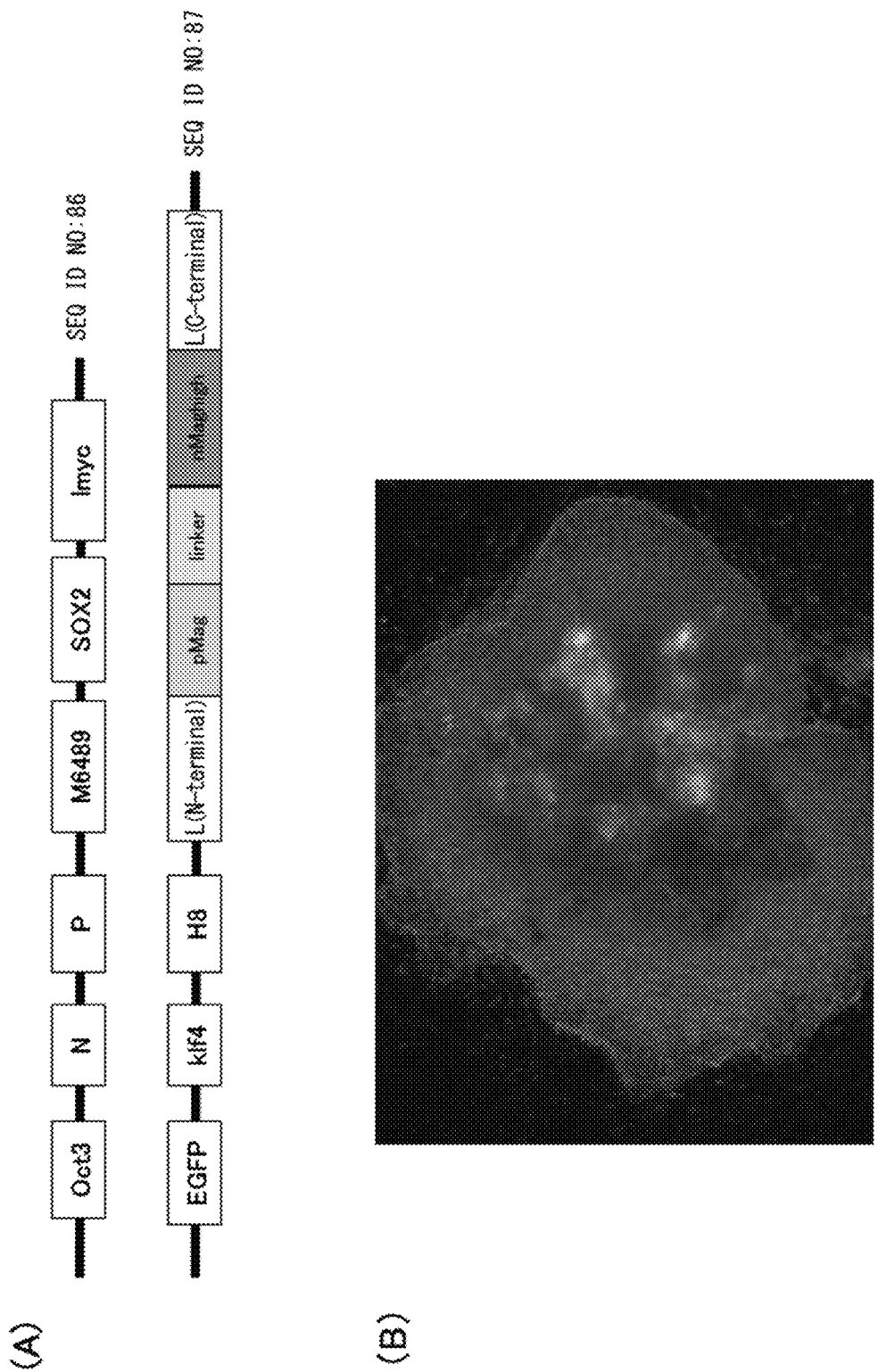

A virus vector was created by integrating the reprogramming factors Oct3/4, Sox2, Klf4, and 1-Myc, as a transcription unit into the genome of the Magnet-L photosensitive measles virus of Example 1. Specifically, the reprogramming gene was transferred into a double measles genome comprising a first genome containing the N gene, P gene and M6489 gene, and a second genome containing the H gene and modified L gene. In the first genome, the Sox2 gene and 1-myc gene were situated upstream from Oct3 and the N gene (SEQ ID NO: 86). In the second genome, the EGFP and Klf4 genes were situated upstream from the H gene (SEQ ID NO: 87) (FIG. 17A). Fibroblasts, and somatic cells obtained from human peripheral blood, were cultured at 37° C. in a 5% $CO_2$ humidified atmosphere in medium suited for each cell type. The medium was discarded and the cells were infected with the virus vector at MOI=0.1 or higher. After infection, the cells were cultured in culture solution for ES/iPS cells. Irradiation of blue LED after infection caused expression of each reprogramming factor in the somatic cells. The expression of each reprogramming factor was examined, and culturing was continued for 20 days or longer for induction to iPS cells (FIG. 17B).

Example 8: Examination of Linker Length

The linker length was changed to confirm the function of the linker during transfer of the photoresponsive gene pMag-nMaghigh into the exogenous gene-transferable region of the L protein gene of the recombinant measles virus having the EGFP transcription unit added (SEQ ID NO: 8), which was created in Example 1. As photoresponsive genes to be transferred there were prepared pMag-linker-nMaghigh linked using a 26-residue linker (SEQ ID NO: 10), pMag-4×linker-nMaghigh linked using a 114-residue linker which was approximately 4 times longer linker-nMaghigh (SEQ ID NO: 80), and pMag-direct-nMaghigh directly linked without a linker (SEQ ID NO: 78). There was also prepared pMag-linker-nMag using nMag instead of nMaghigh (SEQ ID NO: 79). The photoresponsive genes were transferred into the exogenous gene-transferable region of L protein to create plasmids for formation of measles virus genomes containing a modified L protein gene. Transfer of these genes was carried out using an In-fusion kit (Clontech). The sequences of the plasmids in which the photoresponsive genes were transferred were p(+)MV323-pMag-linker-nMaghigh (SEQ ID NO: 14), p(+)MV323-pMag-4×linker-nMaghigh (SEQ ID NO: 81), p(+)MV323-pMag-direct-nMaghigh (SEQ ID NO: 82) and p(+)MV323-pMag-linker-nMag (SEQ ID NO: 83).

Synthesis of Recombinant Measles Virus

BHK/T7-9 cells that had been grown in a 6-well plate were transfected using 0.8 µg of N protein expression plasmid (pCITE-IC-N) (SEQ ID NO: 33), 0.6 µg of P protein expression plasmid (pCITE-IC-PAC) (SEQ ID NO: 34), 1.6 µg of L protein expression plasmid (pCITE-9301B-wtL) (SEQ ID NO: 35) and the plasmid for formation of the recombinant measles virus (5 using an X-tremeGENE HP (Roche). After culturing for 2 days, the BHK/T7-9 cells were overlaid onto Vero/hSLAM cells, for virus rescue.

Confirmation of Photoresponsiveness

Figure 14:
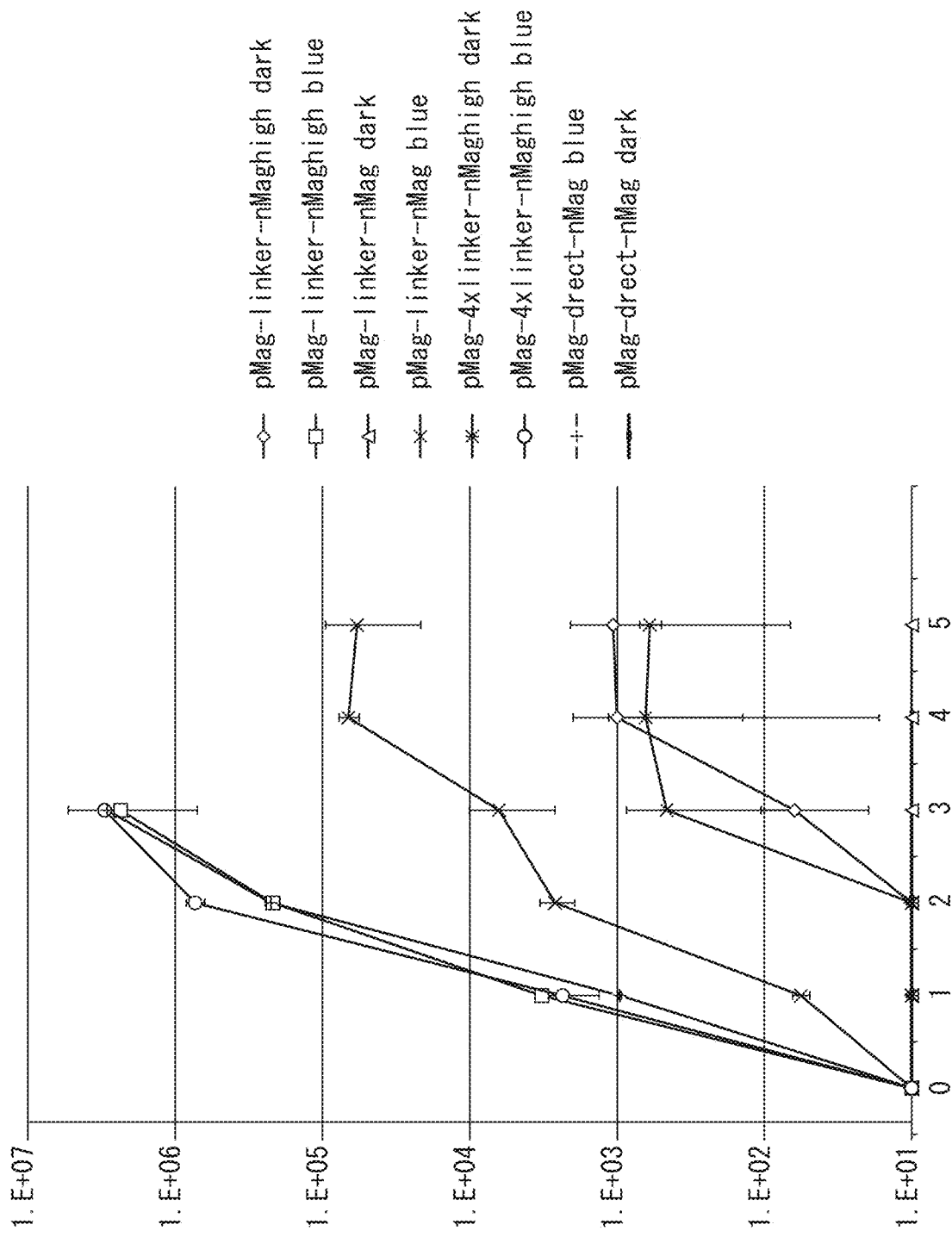

The rescued recombinant measles virus was infected into Vero/hSLAM cells to an MOI of 0.01. After infection, the cells infected with the measles virus incorporating the photoresponsive genes were cultured separately as a blue LED (peak wavelength: 470 nm blue)-irradiated group and a dark environment group, and the presence or absence of EGFP expression was examined (FIG. 14). With blue LED irradiation, the photoresponsive genes pMag-linker-nMaghigh (SEQ ID NO: 10), pMag-4×linker-nMaghigh (SEQ ID NO: 80) and pMag-direct-nMaghigh (SEQ ID NO: 78) all proliferated to a similar degree. Those with pMag-linker-nMag (SEQ ID NO: 79) transferred, on the other hand, had a poorer growth rate than pMag-linker-nMaghigh. In the dark environment group, those with transfer of pMag-linker-nMaghigh (SEQ ID NO: 10) and pMag-4×linker-nMaghigh (SEQ ID NO: 80) exhibited weak growth from the 2nd day onward. Almost no virus proliferation was seen with pMag-direct-nMaghigh (SEQ ID NO: 78) and pMag-linker-nMag (SEQ ID NO: 79).

Example 9: Therapeutic Activity with Measles Virus

Female Balb-c nu/nu mice (5 to 6 weeks old) were administered a suspension of a cancer line (MDA-MB-468) under the ventral skin at $1\times10^7$ cells/mouse. The tumor diameter and body weight were measured every other day. After the tumor length reached at least 2 mm, recombinant measles virus was intratumorally administered at a concentration of $5\times10^5$ IU/mouse, 5 times every other day. The virus used was measles virus in which pMag-linker-nMaghigh (SEQ ID NO: 10) had been transferred as a photoresponsive gene. The mice were divided into a blue light-irradiated group (4 individuals) and a dark (natural light) group (4 individuals), and reared for 60 days. A non-virus-administered dark (natural light) group (4 individuals) was used as a control. The tumor diameter was observed each day, and the mice were euthanized when the length reached 10 mm. The results are shown in FIGS. 16A and B. A reduction in tumor size was produced in the blue light-irradiated group, while in the dark (natural light) group, tumor growth was inhibited but there was no reduction in tumor size. The therapeutic activity of the measles virus against cancer cells was adjustable based on the presence or absence of blue light irradiation.

SEQUENCE LISTING (87 sequences)

SEQ ID NO: 1 - DNA, 450 bp, Artificial Sequence
  pMag
catactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaa

SEQ ID NO: 2 - DNA, 450 bp, Artificial Sequence
  nMaghigh
catactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatccgcaaggcaatcgacaggaatgccgaggtgcaggttgaagtagtcaattttaaaaagaatggacagcgatttgttaatttcctgactatcatacctgttagggacgaaacaggcgagtatcgatactctatgggattccagtgcgaaacagaa

SEQ ID NO: 3 - DNA, 675 bp, Artificial Sequence
  DPK
atggtgagcgtgatcaagcccgacatgaagatcaagctgcgcatggagggcgccgtgaacggccaccccttcgccatcgagggcgtgggcctgggcaagcccttcgagggcaagcagagcatggacctgaaggtgaaggagggcggccccctgcccttcgcctacgacatcctgaccaccgtgttctgctacggcaaccgcgtgttcgccaagtaccccgagaacatcgtggactacttcaagcagagcttccccgagggctacagctgggagcgcagcatgaactacgaggacggcggcatctgcaacgccaccaacgacatcaccctggacggcgactgctacatctacgagatccgcttcgacggcgtgaacttccccgccaacggccccgtgatgcagaagcgcaccgtgaagtgggagcccagcaccgagaagctgtacgtgcgcgacggcgtgctgaagggcgacgtgaacatggccctgagcctggagggcggcggccactaccgctgcgacttcaagaccacctacaaggccaagaaggtggtgcagctgcccgactaccacttcgtggaccaccacatcgagatcaagagccacgacaaggactacagcaacgtgaacctgcacgagcacgccgaggcccacagcgagctgccccgccaggccaag

SEQ ID NO: 4 - DNA, 675 bp, Artificial Sequence
  DPN
atggtgagcgtgatcaagcccgacatgaagatcaagctgcgcatggagggcgccgtgaacggccaccccttcgccatcgagggcgtgggcctgggcaagcccttcgagggcaagcagagcatggacctgaaggtgaaggagggcggccccctgcccttcgcctacgacatcctgaccaccgtgttctgctacggcaaccgcgtgttcgccaagtaccccgagaacatcgtggactacttcaagcagagcttccccgagggctacagctgggagcgcagcatgaactacgaggacggcggcatctgcaacgccaccaacgacatcaccctggacggcgactgctacatctacgagatccgcttcgacggcgtgaacttccccgccaacggccccgtgatgcagaagcgcaccgtgaagtgggagcccagcaccgagaatctgtacgtgcgcgacggcgtgctgaagggcgacgtgaacatggccctgagcctggagggcggcggccactaccgctgcgacttcaagaccacctacaaggccaagaaggtggtgcagctgcccgactaccacttcgtggaccaccacatcgagatcaagagccacgacaaggactacagcaacgtgaacctgcacgagcacgccgaggcccacagcgagctgccccgccaggccaag

SEQ ID NO: 5 - DNA, 1833 bp, Artificial Sequence
  Cry2
aagatggacaaaaagactatagtttggtttagaagagacctaaggattgaggataatcctgcattagcagcagctgctcacgaaggatctgtttttcctgtcttcatttggtgtcctgaagaagaaggacagttttatcctggaagagcttcaagatggtggatgaaacaatcacttgctcacttatctcaatccttgaaggctcttggatctgacctcactttaatcaaaacccacaacacgatttcagcgatcttggattgtatccgcgttaccggtgctacaaaagtcgtctttaaccacctctatgatcctgtttcgttagttcgggaccataccgtaaaggagaagctggtggaacgtgggatctctgtgcaaagctacaatggagatctattgtatgaaccgtgggagatatactgcgaaaagggcaaaccttttacgagtttcaattcttactggaagaaatgcttagatatgtcgattgaatccgttatgcttcctcctccttggcggttgatgccaataactgcagcggctgaagcgatttgggcgtgttcgattgaagaactagggctggagaatgaggccgagaaaccgagcaatgcgttgttaactagagcttggtctccaggatggagcaatgctgataagttactaaatgagttcatcgagaagcagttgatagattatgcaaagaacagcaagaaagttgttgggaattctacttcactactttctccgtatctccatttcggggaaataagcgtcagacacgttttccagtgtgcccggatgaaacaaattatatgggcaagagataagaacagtgaaggagaagaaagtgcagatctttttcttaggggaatcggtttaagagagtattctcggtatatatgtttcaacttcccgtttactcacgagcaatcgttgttgagtcatcttcggtttttcccttgggatgctgatgttgataagttcaaggcctggagacaaggcaggaccggttatccgttggtggatgccggaatgagagagctttgggctaccggatggatgcataacagaataagagtgattgtttcaagctttgctgtgaagtttcttctccttccatggaaatggggaatgaagtatttctgggatacacttttggatgctgatttggaatgtgacatccttggctggcagtatatctctgggagtatccccgatggccacgagcttgatcgcttggacaatcccgcgttacaaggcgccaaatatgacccagaaggtgagtacataaggcaatggcttcccgagcttgcgagattgccaactgaatggatccatcatccatgggacgctcctttaaccgtactcaaagcttctggtgtggaactcggaacaaactatgcgaaacccattgtagacatcgacacagctcgtgagctactagctaaagctatttcaagaacccgtgaagcacagatcatgatcggagcagcacctgatgagattgtagcagatagcttcgaggccttaggggctaataccattaaagaacctggtctttgcccatctgtgtcttctaatgaccaacaagtaccttcggctgttcgttacaacgggtcagcggcagtgaaacctgaggaagaagaagagagagacatgaagaaatctaggggattcgatgaaagggagttgttttcgactgctgaatcttcttcttcttcgagtgtgtttttcgtttcgcagtcttgctcgttggcatcagaagggaagaatctggaaggtattcaagattcatctgatcagattactacaagtttgggaaaaaatggttgcaaa

SEQ ID NO: 6 - DNA, 510 bp, Artificial Sequence
  CIB1N
atgaatggagctataggaggtgaccttttgctcaattttcctgacatgtcggtcctagagcgccaaagggctcacctcaagtacctcaatcccacctttgattctcctctcgccggcttctttgccgattcttcaatgattaccggcggcgagatggacagctatctttcgactgccggtttgaatcttccgatgatgtacggtgagacgacggtggaaggtgattcaagactctcaatttcgccggaaacgacgcttgggactggaaatttcaaggcagcgaagtttgatacagagactaaggattgtaatgaggcggcgaagaagatgacgatgaacagagatgacctagtagaagaaggagaagaagagaagtcgaaaataacagagcaaaacaatgggagcacaaaaagcatcaagaagatgaaacacaaagccaagaaagaagagaacaatttctctaatgattcatctaaagtgacgaaggaattggagaaaacggattatatt

SEQ ID NO: 7 - DNA, 450 bp, Artificial Sequence
  nMag
catactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaa

SEQ ID NO: 8 - DNA, 16752 bp, Artificial Sequence
  EGFP-Measle virus genome
accaaacaaagttgggtaaggatagatcaatcaatgatcatattctagtacacttaggattcaagatcctattatcagggacaagagcaggattagggatatccgagggcgcgccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaagacgtcgagaggccgaggaccagaacaacatccgcctaccctccatcattgttataaaaaacttaggaaccaggtccacacagccgccagccaaccaaccatccactcccacgactggagttcgaacgagatggccacacttttgaggagcttagcattgttcaaaagaaacaaggacaaaccacccattacatcaggatccggtggagccatcagaggaatcaaacacattattatagtaccaattcctggagattcctcaattaccactcgatccagactactggaccggttggtcaggttaattggaaacccggatgtgagcgggcccaaactaacaggggcactaataggtatattatccttatttgtggagtctccaggtcaattgattcagaggatcaccgatgaccctgacgttagcatcaggctgttagaggttgttcagagtgaccagtcacaatctggccttaccttcgcatcaagaggtaccaacatggaggatgaggcggaccaatacttttcacatgatgatccaagcagtagtgatcaatccaggtccggatggttcgagaacaaggaaatctcagatattgaagtgcaagaccctgagggattcaacatgattctgggtaccattctagcccagatctgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctctttacgccgattcatggtggctctaatcctggatatcaagaggacacccgggaacaaacctaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaatctttaccagcaaatgggagaaactgcaccctacatggtaatcctagagaactcaattcagaacaagttcagtgcaggatcataccctctgctctggagctatgccatgggagtaggagtggaacttgaaaactccatgggaggtttgaactttggtcgatcttactttgatccagcatattttagattagggcaagagatggtgaggaggtcagctggaaaggtcagttccacattggcatccgaactcggtatcactgccgaggatgcaaggcttgtttcagagattgcaatgcatactactgaggacaggatcagtagagcggtcggacccagacaagcccaagtgtcatttctacacggtgatcaaagtgagaatgagctaccaggattggggggcaaggaagataggagggtcaaacagggtcggggagaagccagggagagctacagagaaaccgggtccagcagagcaagtgatgcgagagctgcccatcctccaaccagcatgcccctagacattgacactgcatcggagtcaggccaagatccgcaggacagtcgaaggtcagctgacgccctgctcaggctgcaagccatggcaggaatcttggaagaacaaggctcagacacggacacccctagggtatacaatgacagagatcttctagactaggtgcgagaggccgaggaccagaacaacatccgcctaccctccatcattgttataaaaaacttaggaaccaggtccacacagccgccagccaaccaaccatccactcccacgactggagccgatggcagaagagcaggcacgccatgtcaaaaacggactggaatgcatccgggctctcaaggccgagcccatcggctcactggccgtcgaggaagccatggcagcatggtcagaaatatcagacaacccaggacaggaccgagccacctgcaaggaagaggaggcaggcagttcgggtctcagcaaaccatgcctctcagcaattggatcaactgaaggcggtgcacctcgcatccgcggtcagggatctggagaaagcgatgacgacgctgaaactttgggaatcccctcaagaaatctccaggcatcaagcactgggttacagtgttatcatgtttatgatcacagcggtgaagcggttaagggaatccaagatgctgactctatcatggttcaatcaggccttgatggtgatagcaccctctcaggaggagacgatgaatctgaaaacagcgatgtggatattggcgaacctgataccgagggatatgctatcactgaccggggatctgctcccatctctatggggttcagggcttctgatgttgaaactgcagaaggaggggagatccacgagctcctgaaactccaatccagaggcaacaactttccgaagcttgggaaaactctcaatgttcctccgcccccgaaccccagtagggccagcacttccgagacacccattaaaaagggcacagacgcgagattggcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctccgatgtccaagacatcaaaacagccttggccaaaatacacgaggataatcagaagataatctccaagctagaatcattgctgttattgaagggagaagttgagtcaattaagaagcagatcaacaggcaaaatatcagcatatccaccctggaaggacacctctcaagcatcatgattgccattcctggacttgggaaggatcccaacgaccccactgcagatgtcgaactcaatcccgacctgaaacccatcataggcagagattcaggccgagcactggccgaagttctcaagaagcccgttgccagccgacaactccagggaatgactaatggacggaccagttccagaggacagctgctgaaggaatttcaactaaagccgatcgggaaaaaggtgagctcagccgtcgggtttgttcctgacaccggccctgcatcacgcagtgtaatccgctccattataaaatccagccggctagaggaggatcggaagcgttacctgatgactctccttgatgatatcaaaggagccaacgatcttgccaagttccaccagatgctgatgaagataataatgaagtagctacagctcaacttacctgccaaccccatgccagtcgacctaattagtacaacctaaatccattataaaaaacttaggagcaaagtgattgcctcctaagttccacaatgacagagatctacgatttcgacaagtcggcatgggacatcaaagggtcgatcgctccgatacaacctaccacctacagtgatggcaggctggtgccccaggtcagagtcatagatcctggtctaggtgataggaaggatgaatgctttatgtacatgtttctgctgggggttgttgaggacagcgatcccctagggcctccaatcgggcgagcattcgggtccctgcccttaggtgttggtagatccacagcaaaacccgaggaactcctcaaagaggccactgagcttgacatagttgttagacgtacagcagggctcaatgaaaaactggtgttctacaacaacaccccactaaccctcctcacaccttggagaaaggtcctaacaacagggagtgtcttcaatgcaaaccaagtgtgcaatgcggttaatctaataccgctggacaccccgcagaggttccgtgttgtttatatgagcatcacccgtctttcggataacgggtattacaccgttcccagaagaatgctggaattcagatcggtcaatgcagtggccttcaacctgctagtgacccttaggattgacaaggcgattggccctgggaagatcatcgacaatgcagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccactgatggatatcaatgaagaccttaatcggttactctggaggagcagatgcaagatagtaagaatccaggcagttttgcagccatcagttcctcaagaattccgcatttacgacgacgtgatcataaatgatgaccaaggactattcaaagttctgtagaccgcagtgcccagcaatacccgaaaacgacccccctcataatgacagccagaaggcccggacaaaaaagccccctccagaagactccacggaccaagcgagaggccagccagcagccgacagcaagtgtggacaccaggcggcccaagcacagaacagccccgacacaaggccaccaccagccatcccaatctgcgtcctcctcgtgggacccccgaggaccaaccccgaaggtcgctccgaacacagaccaccaaccgcatccccacagctcccgggaaaggaacccccagcaactggaaggcccctccccccctcccccaacgcaagaaccccacaaccgaaccgcacaagcgaccgaggtgacccaaccgcaggcatccgactccttagacagatcctctccccccggcatactaaacaaaacttagggccaaggaacacacacactcgacagaacccagaccccggcccgcggcaccgcgcccccaccccccgaaaaccagagggagcccccaaccaaacccgccggcccccccggtgcccacaggtaggcacaccaacccccgaccagacccagcacccagccaccgacaatccaagacggggggccccccccaaaaaaaggcccccaggggccgacagccagcatcgcgaggaagcacacccaccccacacacgaccacggcaaccgaaccagagtccagaccaccctgggccaccagctcccagactcggccatcaccccgcaaaaaggaaaggccacaacccgcgcaccccagccccgatccggcgggcagccactcaacccgaaccagcacccaagagcgatccctgggggacccccaaaccgcaaaagacatcagtatcccacagcctctccaagtcccccggtctcctcctcttctcgaagggaccaaaagatcaatccaccacatccgacgacactcaattccccacccccaaaggagacaccgggaatcccagaatcaagactcatccagtgtccatcatgggtctcaaggtgaacgtctctgccatattcatggcagtactgttaactctccaaacacccaccggtcaaatccattggggcaatctctctaagataggggtggtagggataggaagtgcaagctacaaagttatgactcgttccagccatcaatcattggtcataaaattaatgcccaatataactctcctcaataactgcacgagggtagagatcgcagaatacaggagactactgagaacagttttggaaccaattagagatgcacttaatgcaatgacccagaatataagaccggttcagagtgtagcttcaagtaggagacacaagagatttgcgggagttgtcctggcaggtgcggccctaggcgttgccacagctgctcagataacagccggcattgcacttcaccagtccatgctgaactctcaagccatcgacaatctgagagcaagcctggaaactactaatcaggcaattgaggcaatcagacaagcagggcaggagatgatattggctgttcagggtgtccaagactacatcaataatgagctgataccgtctatgaaccaactatcttgtgatttaatcggccagaagctagggctcaaattgctcagatactatacagaaatcctgtcattatttggccccagcttacgggaccccatatctgcggagatatccatccaggctttgagctatgcgcttggaggagatatcaataaggtattagaaaagctcggatacagtggaggtgatttactgggcatcttagagagcagaggaataaaggcccggataactcacgtcgacacagagtcctacttcattgtactcagtatagcctatccgacgctgtccgagattaagggggtgattgtccaccggctagagggggtctcgtacaatataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtccaccaagtcctgtgctcgtacactcgtatccgggtcttttgggaaccggttcattttatcacaagggaacctaatagccaattgtgcatcaatcctctgcaagtgttacacaacaggaacgatcattaatcaagaccctgacaagatcctaacatacattgctgccgatcactgcccggtggtcgaggtgaacggtgtgaccatccaagtcgggagcaggaggtatccggacgcggtgtacctgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtttacatcctgattgcagtgtgtcttggagggttgatagggatccccgctttaatatgttgctgcagggggcgctgtaacaaaaagggagaacaagttggtatgtcaagaccaggcctaaagcctgatcttacagggacatcaaaatcctatgtaaggtcgctctgatcctctacaactcttgaaacacagatttcccacaagtctcctcttcgtcatcaagcaaccaccgcatccagcatcaagcccacctgaaattgtctccggcttccctctggccgaacgatatcggtagttaattaaaacttagggtgcaagatcatccacaatgtcaccacaacgagaccgaataaatgccttctacaaagacaacccacatcctaagggaagtaggatagttattaacagagaacatcttatgattgatagaccttatgttttgctggctgttctattcgtcatgtttctgagcttgatcgggttgctagccattgcaggcattagactccatcgtgcagccatctacaccgcagagatccataagagcctcagcaccaatctagatgtaactaactcgatcgagcatcaggtcaaggacgtgctgacaccactcttcaagatcattggtgatgaagtgggcctgaggacacctcagagattcactgacctagtgaaattcatctctgacaaaattaaattccttaatccggatagggagtacgacttcagagatctcacttggtgtatcaacccgccagagagaatcaaattggattatgatcaatactgtgcagatgtggctgctgaagaactcatgaatgcattggtgaactcaactctactggaggccagggcaaccaatcagttcctagctgtctcaaagggaaactgctcagggcccactacaatcagaggtcaattctcaaacatgtcgctgtccctgttggacttgtatttaagtcgaggttacaatgtgtcatctatagtcactatgacatcccagggaatgtacgggggaacttacctagtgggaaagcctaatctgagcagtaaagggtcagagttgtcacaactgagcatgcaccgagtgtttgaagtaggggttatcagaaatccgggtttgggggctccggtgttccatatgacaaactattttgagcaaccagtcagtaatgatttcagcaactgcatggtggctttgggggagcttaaattcgcagccctctgtcacagggaagattctatcacaattccctatcaggggtcagggaaaggtgtcagcttccagctcgtcaagctaggtgtctggaaatccccaaccgacatgcgatcctgggtccccctatcaacggatgatccagtgatagataggctttatctctcatctcacagaggtgttatcgctgacaatcaagcaaaatgggctgtcccgacaacacggacagatgacaagttgcgaatggagacatgcttccagcaggcgtgtaagggtaaaaaccaagcactctgcgagaatcccgagtgggcaccattgaaggataacaggattccttcatacggggtcttgtctgttaatctgagtctgacagttgagcttaaaatcaaaattgcttcaggattcgggccattgatcacacacggttcagggatggacctatacaaaaccaaccacaacaatgtgtattggctgactatcccgccaatgaagaacctagccttaggtgtaatcaacacattggagtggataccgagattcaaggttagtcccaacctcttcactgttccaatcaaggaagcaggcgaggactgccatgccccaacatacctacctgcggaggtggatggtgatgtcaaactcagttccaatctggtaattctacctggtcaggatctccaatatgttttggcaacctacgatacttccagggttgaacatgctgtggtttattatgtttacagcccaagccgctcattttcttacttttatccttttaggttgcctataaagggggtcccaatcgaattacaagtggaatgcttcacatgggacaaaaaactctggtgccgtcacttctgtgtgcttgcggactcagaatctggtggacatatcactcactctgggatggtgggcatgggagtcagctgcacagtcactcgggaagatggaaccaatcgcagatagggctgccagtgaaccgatcacatgatgtcacccagacatcaggcatacccactagtgtgaaatagacatcagaattaagaaaaacgtagggtccaagtggtttcccgttatggactcgctatctgtcaaccagatcttataccctgaagttcacctagatagcccgatagttaccaataagatagtagctatcctggagtatgctcgagtccctcacgcttacagcctggaggaccctacactgtgtcagaacatcaagcaccgcctaaaaaacggattctccaaccaaatgattataaacaatgtggaagttgggaatgtcatcaagtccaagcttaggagttatccggcccactctcatattccatatccaaattgtaatcaggatttatttaacatagaagacaaagagtcaacaaggaagatccgtgagctcctaaaaaagggaaattcgctgtactccaaagtcagtgataaggttttccaatgcctgagggacactaactcacggcttggcctaggctccgaattgagggaggacatcaaggagaaaattattaacttgggagtttacatgcacagctcccaatggtttgagccctttctgttttggtttacagtcaagactgagatgaggtcagtgattaaatcacaaacccatacttgccataggaggagacacacacctgtattcttcactggtagttcagttgagctgttaatctctcgtgaccttgttgctataatcagtaaggaatctcaacatgtatattacctgacgtttgaactggttttgatgtattgtgatgtcatagaggggaggttaatgacagagaccgctatgaccattgatgctaggtatgcagaacttctaggaagagtcagatacatgtggaaactgatagatggtttcttccctgcactcgggaatccaacttatcaaattgtagccatgctggagccactttcacttgcttacctgcaactgagggatataacagtagaactcagaggtgctttccttaaccactgctttactgaaatacatgatgttcttgaccaaaacgggttttctgatgaaggtacttatcatgagttaattgaagccctagattacattttcataactgatgacatacatctgacaggggagattttctcatttttcagaagtttcggccaccccagacttgaagcagtaacggctgctgaaaatgtcaggaaatacatgaatcagcctaaagtcattgtgtatgagactctgatgaaaggtcatgccatattttgtggaatcataatcaacggctatcgtgacaggcacggaggcagttggccacccctgaccctccccctgcatgctgcagacacaatccggaatgctcaagcttcaggtgaagggttaacacatgagcagtgcgttgataactggaaatcatttgctggagtgagatttggctgttttatgcctcttagcctggacagtgatctgacaatgtacctaaaggacaaggcacttgctgctctccaaagggaatgggattcagtttacccgaaagagttcctgcgttacgatcctcccaagggaaccgggtcacggaggcttgtagatgttttccttaatgattcgagctttgacccatatgatatgataatgtatgtcgtaagtggagcctacctccatgaccctgagttcaacctgtcttacagcctgaaagaaaaggagatcaaggaaacaggtagacttttcgctaaaatgacttacaaaatgagggcatgccaagtgatcgctgaaaatctaatctcaaacgggattggcaagtattttaaggacaatgggatggccaaggatgagcacgatttgactaaggcactccacactctggctgtctcaggagtccccaaagatctcaaagaaagtcacaggggggggccagtcttaaaaacctactcccgaagcccagtccacacaagtaccaggaacgttaaagcagaaaaagggtttgtaggattccctcatgtaattcggcagaatcaagacactgatcatccggagaatatagaaacctacgagacagtcagcgcatttatcacgactgatctcaagaagtactgccttaattggagatatgagaccatcagcttatttgcacagaggctaaatgagatttacggattaccctcattttttcagtggctgcataagaggcttgaaacctctgtcctctatgtaagtgaccctcattgcccccccgaccttgacgcccatgtcccgttatgcaaagtccccaatgaccaaatcttcatcaagtaccctatgggaggtatagaagggtattgtcagaagctgtggaccatcagcaccattccctacttatacctggctgcttatgagagcggggtaaggattgcttcgttagtgcaaggggacaatcagaccatagccgtaacaaaaagggtacccagcacatggccttacaaccttaagaaacgggaagctgctagagtaactagagattactttgtaattcttaggcaaaggctacatgacattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcggcatgcagtaatattgctacaacaatggccaaaagcattgagagaggttatgaccgttatcttgcatattccctgaacgtcctaaaagtgatacagcaaattttgatctcccttggcttcacaatcaattcaaccatgacccgggatgtagtcatacccctcctcacaaacaacgatctcttaataaggatggcactgttgcccgctcctattgggggtatgaattatctgaatatgagcaggctgtttgtcagaaacatcggtgatccagtaacatcatcaattgctgatctcaagagaatgattctcgcatcactaatgcctgaagagaccctccatcaagtaatgacacaacaaccgggggactcttcattcctagactgggctagcgacccttactcagcaaatcttgtatgcgtccagagcatcactagactcctcaagaacataactgcaaggtttgtcctgatccacagtccaaacccaatgttaaaagggttattccatgatgacagcaaagaagaggacgagagactggcggcattcctcatggacaggcatattatagtacctagggcagctcatgaaatcctggatcatagtgtcacaggggcaagagagtctattgcaggcatgctagataccacaaaaggcctgattcgagccagcatgaggaagggggggttaacctctcgagtgataaccagattgtccaattatgactatgaacaatttagagcagggatggtgctattgacaggaagaaagagaaatgtcctcattgacaaagagtcatgttcagtgcagctggctagagccctaagaagccatatgtgggcaagactagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagctcgccttcgtaagagccccaagtagatccttgcgatctgccgttagaatagcaacagtgtactcatgggcttacggtgatgatgatagctcttggaacgaagcctggttgttggcaaggcaaagggccaatgtgagcctggaggagctaagggtgatcactcccatctcgacttcgactaatttagcgcataggttgagggatcgtagcactcaagtgaaatactcaggtacatcccttgtccgagtggcaaggtataccacaatctccaacgacaatctctcatttgtcatatcagataagaaggttgatactaactttatataccaacaaggaatgcttctagggttgggtgttttagaaacattgtttcgactcgagaaagatactggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattctagctaagtccacagcactatctatgattgacctggtaacaaaatttgagaaggaccatatgaatgaaatttcagctctcataggggatgacgatatcaatagtttcataactgagtttctgcttatagagccaagattattcaccatctacttgggccagtgtgcagccatcaattgggcatttgatgtacattatcatagaccatcagggaaatatcagatgggtgagctgttgtcttcgttcctttctagaatgagcaaaggagtgtttaaggtgcttgtcaatgctctaagccacccaaagatctacaagaaattctggcattgtggtattatagagcctatccatggtccttcacttgatgctcaaaacttgcacacaactgtgtgcaacatggtttacacatgctatatgacctacctcgacctgttgttgaatgaagagttagaagagttcacatttcttttgtgtgaaagcgatgaggatgtagtaccggacagattcgacaacatccaggcaaaacacttgtgtgttctggcagatttgtactgtcaaccagggacctgcccaccgattcgaggtctaaggccggtagagaaatgtgcagttctaaccgatcatatcaaggcagaggctaggttatctccagcaggatcttcgtggaacataaatccaattattgtagaccattactcatgctctctgacttatctccgtcgaggatctatcaaacagataagattgagagttgatccaggattcatttttgacgccctcgctgaggtaaatgtcagtcagccaaaggtcggcagcaacaacatctcaaatatgagcatcaaggatttcagacctccacacgatgatgttgcaaaattgctcaaagatatcaacacaagcaagcacaatcttcccatttcagggggtagtctcgccaattatgaaatccatgctttccgcagaatcgggttaaactcatctgcttgctacaaagctgttgagatatcaacattaattaggagatgccttgagccaggggaagacggcttgttcttgggtgaggggtcgggttctatgttgatcacttataaggagatactaaaactaaacaagtgcttctataatagtggggtttccgccaattctagatctggtcaaagggaattagcaccctatccctccgaagttggccttgtcgaacacagaatgggagtaggtaatattgtcaaggtgctctttaacgggaggcccgaagtcacgtgggtaggcagtatagattgcttcaatttcatagtcagtaatatccctacctctagtgtggggtttatccattcagatatagagaccttacctaacaaagatactatagagaagctagaggaattggcagccatcttatcgatggctctactccttggcaaaataggatcaatactggtgattaagcttatgcctttcagcggggattttgttcagggatttataagctatgtagggtctcattatagagaagtgaaccttgtctaccctaggtacagcaacttcatatctactgaatcttatttagttatgacagatctcaaagctaaccggctaatgaatcctgaaaagatcaagcagcagataattgaatcatctgtacggacttcacctggacttataggtcacatcctatccattaagcaactaagctgcatacaagcaattgtgggaggcgcggttagtagaggtgatatcaaccctattctgaaaaaacttacacctatagagcaggtgctgatcagttgcgggttggcaattaacggacctaaactgtgcaaagaattaatccaccatgatgttgcctcagggcaagatggattgcttaactctatactcatcctctacagggagttggcaagattcaaagacaaccaaagaagtcaacaagggatgttccacgcttaccccgtattggtaagtagtaggcaacgagaacttgtatctaggatcactcgcaaattttgggggcatattcttctttactccgggaacagaaagttgataaatcggtttatccagaatctcaagtccggttatctagtactagacttacaccagaatatcttcgttaagaatctatccaagtcagagaaacagattattatgacggggggtttaaaacgtgagtgggtttttaaggtaacagtcaaggagaccaaagaatggtacaagttagtcggatacagcgctctgattaaggattaattggttgaactccggaaccctaatcctgccctaggtagttaggcattatttgcaatatattaaagaaaactttgaaaatacgaagtttctattcccagctttgtctggt

SEQ ID NO: 9 - DNA, 1428 bp, Artificial Sequence
  DP
atggtgagcgtgatcaagcccgacatgaagatcaagctgcgcatggagggcgccgtgaacggccaccccttcgccatcgagggcgtgggcctgggcaagcccttcgagggcaagcagagcatggacctgaaggtgaaggagggcggccccctgcccttcgcctacgacatcctgaccaccgtgttctgctacggcaaccgcgtgttcgccaagtaccccgagaacatcgtggactacttcaagcagagcttccccgagggctacagctgggagcgcagcatgaactacgaggacggcggcatctgcaacgccaccaacgacatcaccctggacggcgactgctacatctacgagatccgcttcgacggcgtgaacttccccgccaacggccccgtgatgcagaagcgcaccgtgaagtgggagcccagcaccgagaagctgtacgtgcgcgacggcgtgctgaagggcgacgtgaacatggccctgagcctggagggcggcggccactaccgctgcgacttcaagaccacctacaaggccaagaaggtggtgcagctgcccgactaccacttcgtggaccaccacatcgagatcaagagccacgacaaggactacagcaacgtgaacctgcacgagcacgccgaggcccacagcgagctgccccgccaggccaagaccggtaattccgctgacggcggcggaggatcgggtggtagtggtggttcaggaggaggatcgacccaaggaggatccatggtgagcgtgatcaagcccgacatgaagatcaagctgcgcatggagggcgccgtgaacggccaccccttcgccatcgagggcgtgggcctgggcaagcccttcgagggcaagcagagcatggacctgaaggtgaaggagggcggccccctgcccttcgcctacgacatcctgaccaccgtgttctgctacggcaaccgcgtgttcgccaagtaccccgagaacatcgtggactacttcaagcagagcttccccgagggctacagctgggagcgcagcatgaactacgaggacggcggcatctgcaacgccaccaacgacatcaccctggacggcgactgctacatctacgagatccgcttcgacggcgtgaacttccccgccaacggccccgtgatgcagaagcgcaccgtgaagtgggagcccagcaccgagaatctgtacgtgcgcgacggcgtgctgaagggcgacgtgaacatggccctgagcctggagggcggcggccactaccgctgcgacttcaagaccacctacaaggccaagaaggtggtgcagctgcccgactaccacttcgtggaccaccacatcgagatcaagagccacgacaaggactacagcaacgtgaacctgcacgagcacgccgaggcccacagcgagctgccccgccaggccaag

SEQ ID NO: 10 - DNA, 981 bp, Artificial Sequence
  pMag-linker-nMaghigh
catactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaaaccggtaattccgctgacggcggcggaggatcgggtggtagtggtggttcaggaggaggatcgacccaaggaggatccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatccgcaaggcaatcgacaggaatgccgaggtgcaggttgaagtagtcaattttaaaaagaatggacagcgatttgttaatttcctgactatcatacctgttagggacgaaacaggcgagtatcgatactctatgggattccagtgcgaaacagaa

SEQ ID NO: 11 - DNA, 2079 bp, Artificial Sequence
  Cry2-linker-CIB1N
aagatggacaaaaagactatagtttggtttagaagagacctaaggattgaggataatcctgcattagcagcagctgctcacgaaggatctgtttttcctgtcttcatttggtgtcctgaagaagaaggacagttttatcctggaagagcttcaagatggtggatgaaacaatcacttgctcacttatctcaatccttgaaggctcttggatctgacctcactttaatcaaaacccacaacacgatttcagcgatcttggattgtatccgcgttaccggtgctacaaaagtcgtctttaaccacctctatgatcctgtttcgttagttcgggaccataccgtaaaggagaagctggtggaacgtgggatctctgtgcaaagctacaatggagatctattgtatgaaccgtgggagatatactgcgaaaagggcaaaccttttacgagtttcaattcttactggaagaaatgcttagatatgtcgattgaatccgttatgcttcctcctccttggcggttgatgccaataactgcagcggctgaagcgatttgggcgtgttcgattgaagaactagggctggagaatgaggccgagaaaccgagcaatgcgttgttaactagagcttggtctccaggatggagcaatgctgataagttactaaatgagttcatcgagaagcagttgatagattatgcaaagaacagcaagaaagttgttgggaattctacttcactactttctccgtatctccatttcggggaaataagcgtcagacacgttttccagtgtgcccggatgaaacaaattatatgggcaagagataagaacagtgaaggagaagaaagtgcagatctttttcttaggggaatcggtttaagagagtattctcggtatatatgtttcaacttcccgtttactcacgagcaatcgttgttgagtcatcttcggtttttcccttgggatgctgatgttgataagttcaaggcctggagacaaggcaggaccggttatccgttggtggatgccggaatgagagagctttgggctaccggatggatgcataacagaataagagtgattgtttcaagctttgctgtgaagtttcttctccttccatggaaatggggaatgaagtatttctgggatacacttttggatgctgatttggaatgtgacatccttggctggcagtatatctctgggagtatccccgatggccacgagcttgatcgcttggacaatcccgcgttacaaggcgccaaatatgacccagaaggtgagtacataaggcaatggcttcccgagcttgcgagattgccaactgaatggatccatcatccatgggacgctcctttaaccgtactcaaagcttctggtgtggaactcggaacaaactatgcgaaacccattgtagacatcgacacagctcgtgagctactagctaaagctatttcaagaacccgtgaagcacagatcatgatcggagcagcaaccggtaattccgctgacggcggcggaggatcgggtggtagtggtggttcaggaggaggatcgacccaaggaggatccatgaatggagctataggaggtgaccttttgctcaattttcctgacatgtcggtcctagagcgccaaagggctcacctcaagtacctcaatcccacctttgattctcctctcgccggcttctttgccgattcttcaatgattaccggcggcgagatggacagctatctttcgactgccggtttgaatcttccgatgatgtacggtgagacgacggtggaaggtgattcaagactctcaatttcgccggaaacgacgcttgggactggaaatttcaaggcagcgaagtttgatacagagactaaggattgtaatgaggcggcgaagaagatgacgatgaacagagatgacctagtagaagaaggagaagaagagaagtcgaaaataacagagcaaaacaatgggagcacaaaaagcatcaagaagatgaaacacaaagccaagaaagaagagaacaatttctctaatgattcatctaaagtgacgaaggaattggagaaaacggattatatt

SEQ ID NO: 12 - DNA, 2079 bp, Artificial Sequence; identical to SEQ ID NO: 11
  CRY2PHR-linker-CIB1N

SEQ ID NO: 13 - DNA, 21146 bp, Artificial Sequence
  p(+)MV323-DPK?DPN
accaaacaaagttgggtaaggatagatcaatcaatgatcatattctagtacacttaggattcaagatcctattatcagggacaagagcaggattagggatatccgagggcgcgccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaagacgtcgagaggccgaggaccagaacaacatccgcctaccctccatcattgttataaaaaacttaggaaccaggtccacacagccgccagccaaccaaccatccactcccacgactggagttcgaacgagatggccacacttttgaggagcttagcattgttcaaaagaaacaaggacaaaccacccattacatcaggatccggtggagccatcagaggaatcaaacacattattatagtaccaattcctggagattcctcaattaccactcgatccagactactggaccggttggtcaggttaattggaaacccggatgtgagcgggcccaaactaacaggggcactaataggtatattatccttatttgtggagtctccaggtcaattgattcagaggatcaccgatgaccctgacgttagcatcaggctgttagaggttgttcagagtgaccagtcacaatctggccttaccttcgcatcaagaggtaccaacatggaggatgaggcggaccaatacttttcacatgatgatccaagcagtagtgatcaatccaggtccggatggttcgagaacaaggaaatctcagatattgaagtgcaagaccctgagggattcaacatgattctgggtaccattctagcccagatctgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctctttacgccgattcatggtggctctaatcctggatatcaagaggacacccgggaacaaacctaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaatctttaccagcaaatgggagaaactgcaccctacatggtaatcctagagaactcaattcagaacaagttcagtgcaggatcataccctctgctctggagctatgccatgggagtaggagtggaacttgaaaactccatgggaggtttgaactttggtcgatcttactttgatccagcatattttagattagggcaagagatggtgaggaggtcagctggaaaggtcagttccacattggcatccgaactcggtatcactgccgaggatgcaaggcttgtttcagagattgcaatgcatactactgaggacaggatcagtagagcggtcggacccagacaagcccaagtgtcatttctacacggtgatcaaagtgagaatgagctaccaggattggggggcaaggaagataggagggtcaaacagggtcggggagaagccagggagagctacagagaaaccgggtccagcagagcaagtgatgcgagagctgcccatcctccaaccagcatgcccctagacattgacactgcatcggagtcaggccaagatccgcaggacagtcgaaggtcagctgacgccctgctcaggctgcaagccatggcaggaatcttggaagaacaaggctcagacacggacacccctagggtatacaatgacagagatcttctagactaggtgcgagaggccgaggaccagaacaacatccgcctaccctccatcattgttataaaaaacttaggaaccaggtccacacagccgccagccaaccaaccatccactcccacgactggagccgatggcagaagagcaggcacgccatgtcaaaaacggactggaatgcatccgggctctcaaggccgagcccatcggctcactggccgtcgaggaagccatggcagcatggtcagaaatatcagacaacccaggacaggaccgagccacctgcaaggaagaggaggcaggcagttcgggtctcagcaaaccatgcctctcagcaattggatcaactgaaggcggtgcacctcgcatccgcggtcagggatctggagaaagcgatgacgacgctgaaactttgggaatcccctcaagaaatctccaggcatcaagcactgggttacagtgttatcatgtttatgatcacagcggtgaagcggttaagggaatccaagatgctgactctatcatggttcaatcaggccttgatggtgatagcaccctctcaggaggagacgatgaatctgaaaacagcgatgtggatattggcgaacctgataccgagggatatgctatcactgaccggggatctgctcccatctctatggggttcagggcttctgatgttgaaactgcagaaggaggggagatccacgagctcctgaaactccaatccagaggcaacaactttccgaagcttgggaaaactctcaatgttcctccgcccccgaaccccagtagggccagcacttccgagacacccattaaaaagggcacagacgcgagattggcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctccgatgtccaagacatcaaaacagccttggccaaaatacacgaggataatcagaagataatctccaagctagaatcattgctgttattgaagggagaagttgagtcaattaagaagcagatcaacaggcaaaatatcagcatatccaccctggaaggacacctctcaagcatcatgattgccattcctggacttgggaaggatcccaacgaccccactgcagatgtcgaactcaatcccgacctgaaacccatcataggcagagattcaggccgagcactggccgaagttctcaagaagcccgttgccagccgacaactccagggaatgactaatggacggaccagttccagaggacagctgctgaaggaatttcaactaaagccgatcgggaaaaaggtgagctcagccgtcgggtttgttcctgacaccggccctgcatcacgcagtgtaatccgctccattataaaatccagccggctagaggaggatcggaagcgttacctgatgactctccttgatgatatcaaaggagccaacgatcttgccaagttccaccagatgctgatgaagataataatgaagtagctacagctcaacttacctgccaaccccatgccagtcgacctaattagtacaacctaaatccattataaaaaacttaggagcaaagtgattgcctcctaagttccacaatgacagagatctacgatttcgacaagtcggcatgggacatcaaagggtcgatcgctccgatacaacctaccacctacagtgatggcaggctggtgccccaggtcagagtcatagatcctggtctaggtgataggaaggatgaatgctttatgtacatgtttctgctgggggttgttgaggacagcgatcccctagggcctccaatcgggcgagcattcgggtccctgcccttaggtgttggtagatccacagcaaaacccgaggaactcctcaaagaggccactgagcttgacatagttgttagacgtacagcagggctcaatgaaaaactggtgttctacaacaacaccccactaaccctcctcacaccttggagaaaggtcctaacaacagggagtgtcttcaatgcaaaccaagtgtgcaatgcggttaatctaataccgctggacaccccgcagaggttccgtgttgtttatatgagcatcacccgtctttcggataacgggtattacaccgttcccagaagaatgctggaattcagatcggtcaatgcagtggccttcaacctgctagtgacccttaggattgacaaggcgattggccctgggaagatcatcgacaatgcagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccactgatggatatcaatgaagaccttaatcggttactctggaggagcagatgcaagatagtaagaatccaggcagttttgcagccatcagttcctcaagaattccgcatttacgacgacgtgatcataaatgatgaccaaggactattcaaagttctgtagaccgcagtgcccagcaatacccgaaaacgacccccctcataatgacagccagaaggcccggacaaaaaagccccctccagaagactccacggaccaagcgagaggccagccagcagccgacagcaagtgtggacaccaggcggcccaagcacagaacagccccgacacaaggccaccaccagccatcccaatctgcgtcctcctcgtgggacccccgaggaccaaccccgaaggtcgctccgaacacagaccaccaaccgcatccccacagctcccgggaaaggaacccccagcaactggaaggcccctccccccctcccccaacgcaagaaccccacaaccgaaccgcacaagcgaccgaggtgacccaaccgcaggcatccgactccttagacagatcctctccccccggcatactaaacaaaacttagggccaaggaacacacacactcgacagaacccagaccccggcccgcggcaccgcgcccccaccccccgaaaaccagagggagcccccaaccaaacccgccggcccccccggtgcccacaggtaggcacaccaacccccgaccagacccagcacccagccaccgacaatccaagacggggggccccccccaaaaaaaggcccccaggggccgacagccagcatcgcgaggaagcacacccaccccacacacgaccacggcaaccgaaccagagtccagaccaccctgggccaccagctcccagactcggccatcaccccgcaaaaaggaaaggccacaacccgcgcaccccagccccgatccggcgggcagccactcaacccgaaccagcacccaagagcgatccctgggggacccccaaaccgcaaaagacatcagtatcccacagcctctccaagtcccccggtctcctcctcttctcgaagggaccaaaagatcaatccaccacatccgacgacactcaattccccacccccaaaggagacaccgggaatcccagaatcaagactcatccagtgtccatcatgggtctcaaggtgaacgtctctgccatattcatggcagtactgttaactctccaaacacccaccggtcaaatccattggggcaatctctctaagataggggtggtagggataggaagtgcaagctacaaagttatgactcgttccagccatcaatcattggtcataaaattaatgcccaatataactctcctcaataactgcacgagggtagagatcgcagaatacaggagactactgagaacagttttggaaccaattagagatgcacttaatgcaatgacccagaatataagaccggttcagagtgtagcttcaagtaggagacacaagagatttgcgggagttgtcctggcaggtgcggccctaggcgttgccacagctgctcagataacagccggcattgcacttcaccagtccatgctgaactctcaagccatcgacaatctgagagcaagcctggaaactactaatcaggcaattgaggcaatcagacaagcagggcaggagatgatattggctgttcagggtgtccaagactacatcaataatgagctgataccgtctatgaaccaactatcttgtgatttaatcggccagaagctagggctcaaattgctcagatactatacagaaatcctgtcattatttggccccagcttacgggaccccatatctgcggagatatccatccaggctttgagctatgcgcttggaggagatatcaataaggtattagaaaagctcggatacagtggaggtgatttactgggcatcttagagagcagaggaataaaggcccggataactcacgtcgacacagagtcctacttcattgtactcagtatagcctatccgacgctgtccgagattaagggggtgattgtccaccggctagagggggtctcgtacaatataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtccaccaagtcctgtgctcgtacactcgtatccgggtcttttgggaaccggttcattttatcacaagggaacctaatagccaattgtgcatcaatcctctgcaagtgttacacaacaggaacgatcattaatcaagaccctgacaagatcctaacatacattgctgccgatcactgcccggtggtcgaggtgaacggtgtgaccatccaagtcgggagcaggaggtatccggacgcggtgtacctgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtttacatcctgattgcagtgtgtcttggagggttgatagggatccccgctttaatatgttgctgcagggggcgctgtaacaaaaagggagaacaagttggtatgtcaagaccaggcctaaagcctgatcttacagggacatcaaaatcctatgtaaggtcgctctgatcctctacaactcttgaaacacagatttcccacaagtctcctcttcgtcatcaagcaaccaccgcatccagcatcaagcccacctgaaattgtctccggcttccctctggccgaacgatatcggtagttaattaaaacttagggtgcaagatcatccacaatgtcaccacaacgagaccgaataaatgccttctacaaagacaacccacatcctaagggaagtaggatagttattaacagagaacatcttatgattgatagaccttatgttttgctggctgttctattcgtcatgtttctgagcttgatcgggttgctagccattgcaggcattagactccatcgtgcagccatctacaccgcagagatccataagagcctcagcaccaatctagatgtaactaactcgatcgagcatcaggtcaaggacgtgctgacaccactcttcaagatcattggtgatgaagtgggcctgaggacacctcagagattcactgacctagtgaaattcatctctgacaaaattaaattccttaatccggatagggagtacgacttcagagatctcacttggtgtatcaacccgccagagagaatcaaattggattatgatcaatactgtgcagatgtggctgctgaagaactcatgaatgcattggtgaactcaactctactggaggccagggcaaccaatcagttcctagctgtctcaaagggaaactgctcagggcccactacaatcagaggtcaattctcaaacatgtcgctgtccctgttggacttgtatttaagtcgaggttacaatgtgtcatctatagtcactatgacatcccagggaatgtacgggggaacttacctagtgggaaagcctaatctgagcagtaaagggtcagagttgtcacaactgagcatgcaccgagtgtttgaagtaggggttatcagaaatccgggtttgggggctccggtgttccatatgacaaactattttgagcaaccagtcagtaatgatttcagcaactgcatggtggctttgggggagcttaaattcgcagccctctgtcacagggaagattctatcacaattccctatcaggggtcagggaaaggtgtcagcttccagctcgtcaagctaggtgtctggaaatccccaaccgacatgcgatcctgggtccccctatcaacggatgatccagtgatagataggctttatctctcatctcacagaggtgttatcgctgacaatcaagcaaaatgggctgtcccgacaacacggacagatgacaagttgcgaatggagacatgcttccagcaggcgtgtaagggtaaaaaccaagcactctgcgagaatcccgagtgggcaccattgaaggataacaggattccttcatacggggtcttgtctgttaatctgagtctgacagttgagcttaaaatcaaaattgcttcaggattcgggccattgatcacacacggttcagggatggacctatacaaaaccaaccacaacaatgtgtattggctgactatcccgccaatgaagaacctagccttaggtgtaatcaacacattggagtggataccgagattcaaggttagtcccaacctcttcactgttccaatcaaggaagcaggcgaggactgccatgccccaacatacctacctgcggaggtggatggtgatgtcaaactcagttccaatctggtaattctacctggtcaggatctccaatatgttttggcaacctacgatacttccagggttgaacatgctgtggtttattatgtttacagcccaagccgctcattttcttacttttatccttttaggttgcctataaagggggtcccaatcgaattacaagtggaatgcttcacatgggacaaaaaactctggtgccgtcacttctgtgtgcttgcggactcagaatctggtggacatatcactcactctgggatggtgggcatgggagtcagctgcacagtcactcgggaagatggaaccaatcgcagatagggctgccagtgaaccgatcacatgatgtcacccagacatcaggcatacccactagtgtgaaatagacatcagaattaagaaaaacgtagggtccaagtggtttcccgttatggactcgctatctgtcaaccagatcttataccctgaagttcacctagatagcccgatagttaccaataagatagtagctatcctggagtatgctcgagtccctcacgcttacagcctggaggaccctacactgtgtcagaacatcaagcaccgcctaaaaaacggattctccaaccaaatgattataaacaatgtggaagttgggaatgtcatcaagtccaagcttaggagttatccggcccactctcatattccatatccaaattgtaatcaggatttatttaacatagaagacaaagagtcaacaaggaagatccgtgagctcctaaaaaagggaaattcgctgtactccaaagtcagtgataaggttttccaatgcctgagggacactaactcacggcttggcctaggctccgaattgagggaggacatcaaggagaaaattattaacttgggagtttacatgcacagctcccaatggtttgagccctttctgttttggtttacagtcaagactgagatgaggtcagtgattaaatcacaaacccatacttgccataggaggagacacacacctgtattcttcactggtagttcagttgagctgttaatctctcgtgaccttgttgctataatcagtaaggaatctcaacatgtatattacctgacgtttgaactggttttgatgtattgtgatgtcatagaggggaggttaatgacagagaccgctatgaccattgatgctaggtatgcagaacttctaggaagagtcagatacatgtggaaactgatagatggtttcttccctgcactcgggaatccaacttatcaaattgtagccatgctggagccactttcacttgcttacctgcaactgagggatataacagtagaactcagaggtgctttccttaaccactgctttactgaaatacatgatgttcttgaccaaaacgggttttctgatgaaggtacttatcatgagttaattgaagccctagattacattttcataactgatgacatacatctgacaggggagattttctcatttttcagaagtttcggccaccccagacttgaagcagtaacggctgctgaaaatgtcaggaaatacatgaatcagcctaaagtcattgtgtatgagactctgatgaaaggtcatgccatattttgtggaatcataatcaacggctatcgtgacaggcacggaggcagttggccacccctgaccctccccctgcatgctgcagacacaatccggaatgctcaagcttcaggtgaagggttaacacatgagcagtgcgttgataactggaaatcatttgctggagtgagatttggctgttttatgcctcttagcctggacagtgatctgacaatgtacctaaaggacaaggcacttgctgctctccaaagggaatgggattcagtttacccgaaagagttcctgcgttacgatcctcccaagggaaccgggtcacggaggcttgtagatgttttccttaatgattcgagctttgacccatatgatatgataatgtatgtcgtaagtggagcctacctccatgaccctgagttcaacctgtcttacagcctgaaagaaaaggagatcaaggaaacaggtagacttttcgctaaaatgacttacaaaatgagggcatgccaagtgatcgctgaaaatctaatctcaaacgggattggcaagtattttaaggacaatgggatggccaaggatgagcacgatttgactaaggcactccacactctggctgtctcaggagtccccaaagatctcaaagaaagtcacaggggggggccagtcttaaaaacctactcccgaagcccagtccacacaagtaccaggaacgttaaagcagaaaaagggtttgtaggattccctcatgtaattcggcagaatcaagacactgatcatccggagaatatagaaacctacgagacagtcagcgcatttatcacgactgatctcaagaagtactgccttaattggagatatgagaccatcagcttatttgcacagaggctaaatgagatttacggattaccctcattttttcagtggctgcataagaggcttgaaacctctgtcctctatgtaagtgaccctcattgcccccccgaccttgacgcccatgtcccgttatgcaaagtccccaatgaccaaatcttcatcaagtaccctatgggaggtatagaagggtattgtcagaagctgtggaccatcagcaccattccctacttatacctggctgcttatgagagccgggtaaggattgcttcgttagtgcaaggggacaatcagaccatagccgtaacaaaaagggtacccagcacatggcattacaaccttaagaaacgggaagctgctagagtaactagagattactttgtaattcttaggcaaaggctacatgacattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcggcatgcagtaatattgctacaacaatggccaaaagcattgagagaggttatgaccgttatcttgcatattccctgaacgtcctaaaagtgatacagcaaattttgatctcccttggcttcacaatcaattcaaccatgacccgggatgtagtcatacccctcctcacaaacaacgatctcttaataaggatggcactgttgcccgctcctattgggggtatgaattatctgaatatgagcaggctgtttgtcagaaacatcggtgatccagtaacatcatcaattgctgatctcaagagaatgattctcgcatcactaatgcctgaagagaccctccatcaagtaatgacacaacaaccgggggactcttcattcctagactgggctagcgacccttactcagcaaatcttgtatgcgtccagagcatcactagactcctcaagaacataactgcaaggtttgtcctgatccacagtccaaacccaatgttaaaagggttattccatgatgacagcaaagaagaggacgagagactggcggcattcctcatggacaggcatattatagtacctagggcagctcatgaaatcctggatcatagtgtcacaggggcaagagagtctattgcaggcatgctagataccacaaaaggcctgattcgagccagcatgaggaagggggggttaacctctcgagtgataaccagattgtccaattatgactatgaacaatttagagcagggatggtgctattgacaggaagaaagagaaatgtcctcattgacaaagagtcatgttcagtgcagctggctagagccctaagaagccatatgtgggcaagactagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagctcgccttcgtaagagccccaagtagatccttgcgatctgccgttagaatagcaacagtgtactcatgggcttacggtgatgatgatagctcttggaacgaagcctggttgttggcaaggcaaagggccaatgtgagcctggaggagctaagggtgatcactcccatctcgacttcgactaatttagcgcataggttgagggatcgtagcactcaagtgaaatactcaggtacatcccttgtccgagtggcaaggtataccacaatctccaacgacaatctctcatttgtcatatcagataagaaggttgatactaactttatataccaacaaggaatgcttctagggttgggtgttttagaaacattgtttcgactcgagaaagatactggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattctagctaagtccacagcactatctatgattgacctggtaacaaaatttgagaaggaccatatgaatgaaatttcagctctcataggggatgacgatatcaatagtttcataactgagtttctgcttatagagccaagattattcaccatctacttgggccagtgtgcagccatcaattgggcatttgatgtacattatcatagaccatcagggaaatatcagatgggtgagctgttgtcttcgttcctttctagaatgagcaaaggagtgtttaaggtgcttgtcaatgctctaagccacccaaagatctacaagaaattctggcattgtggtattatagagcctatccatggtccttcacttgatgctcaaaacttgcacacaactgtgtgcaacatggtttacacatgctatatgacctacctcgacctgttgttgaatgaagagttagaagagttcacatttcttttgtgtgaaagcgatgaggatgtagtaccggacagattcgacaacatccaggcaaaacacttgtgtgttctggcagatttgtactgtcaaccagggacctgcccaccgattcgaggtctaaggccggtagagaaatgtgcagttctaaccgatcatatcaaggcagaggctaggttatctccagcaggatcttcgtggaacataaatccaattattgtagaccattactcatgctctctgacttatctccgtcgaggatctatcaaacagataagattgagagttgatccaggattcatttttgacgccctcgctgaggtaaatgtcagtcagccaaaggtcggcagcgacgtcatggtgagcgtgatcaagcccgacatgaagatcaagctgcgcatggagggcgccgtgaacggccaccccttcgccatcgagggcgtgggcctgggcaagcccttcgagggcaagcagagcatggacctgaaggtgaaggagggcggccccctgcccttcgcctacgacatcctgaccaccgtgttctgctacggcaaccgcgtgttcgccaagtaccccgagaacatcgtggactacttcaagcagagcttccccgagggctacagctgggagcgcagcatgaactacgaggacggcggcatctgcaacgccaccaacgacatcaccctggacggcgactgctacatctacgagatccgcttcgacggcgtgaacttccccgccaacggccccgtgatgcagaagcgcaccgtgaagtgggagcccagcaccgagaagctgtacgtgcgcgacggcgtgctgaagggcgacgtgaacatggccctgagcctggagggcggcggccactaccgctgcgacttcaagaccacctacaaggccaagaaggtggtgcagctgcccgactaccacttcgtggaccaccacatcgagatcaagagccacgacaaggactacagcaacgtgaacctgcacgagcacgccgaggcccacagcgagctgccccgccaggccaagaccggtaattccgctgacggcggcggaggatcgggtggtagtggtggttcaggaggaggatcgacccaaggaggatccatggtgagcgtgatcaagcccgacatgaagatcaagctgcgcatggagggcgccgtgaacggccaccccttcgccatcgagggcgtgggcctgggcaagcccttcgagggcaagcagagcatggacctgaaggtgaaggagggcggccccctgcccttcgcctacgacatcctgaccaccgtgttctgctacggcaaccgcgtgttcgccaagtaccccgagaacatcgtggactacttcaagcagagcttccccgagggctacagctgggagcgcagcatgaactacgaggacggcggcatctgcaacgccaccaacgacatcaccctggacggcgactgctacatctacgagatccgcttcgacggcgtgaacttccccgccaacggccccgtgatgcagaagcgcaccgtgaagtgggagcccagcaccgagaatctgtacgtgcgcgacggcgtgctgaagggcgacgtgaacatggccctgagcctggagggcggcggccactaccgctgcgacttcaagaccacctacaaggccaagaaggtggtgcagctgcccgactaccacttcgtggaccaccacatcgagatcaagagccacgacaaggactacagcaacgtgaacctgcacgagcacgccgaggcccacagcgagctgccccgccaggccaaggacgtcatctcaaatatgagcatcaaggatttcagacctccacacgatgatgttgcaaaattgctcaaagatatcaacacaagcaagcacaatcttcccatttcagggggtagtctcgccaattatgaaatccatgctttccgcagaatcgggttaaactcatctgcttgctacaaagctgttgagatatcaacattaattaggagatgccttgagccaggggaagacggcttgttcttgggtgaggggtcgggttctatgttgatcacttataaggagatactaaaactaaacaagtgcttctataatagtggggtttccgccaattctagatctggtcaaagggaattagcaccctatccctccgaagttggccttgtcgaacacagaatgggagtaggtaatattgtcaaggtgctctttaacgggaggcccgaagtcacgtgggtaggcagtatagattgcttcaatttcatagtcagtaatatccctacctctagtgtggggtttatccattcagatatagagaccttacctaacaaagatactatagagaagctagaggaattggcagccatcttatcgatggctctactccttggcaaaataggatcaatactggtgattaagcttatgcctttcagcggggattttgttcagggatttataagctatgtagggtctcattatagagaagtgaaccttgtctaccctaggtacagcaacttcatatctactgaatcttatttagttatgacagatctcaaagctaaccggctaatgaatcctgaaaagatcaagcagcagataattgaatcatctgtacggacttcacctggacttataggtcacatcctatccattaagcaactaagctgcatacaagcaattgtgggaggcgcggttagtagaggtgatatcaaccctattctgaaaaaacttacacctatagagcaggtgctgatcagttgcgggttggcaattaacggacctaaactgtgcaaagaattaatccaccatgatgttgcctcagggcaagatggattgcttaactctatactcatcctctacagggagttggcaagattcaaagacaaccaaagaagtcaacaagggatgttccacgcttaccccgtattggtaagtagtaggcaacgagaacttgtatctaggatcactcgcaaattttgggggcatattcttctttactccgggaacagaaagttgataaatcggtttatccagaatctcaagtccggttatctagtactagacttacaccagaatatcttcgttaagaatctatccaagtcagagaaacagattattatgacggggggtttaaaacgtgagtgggtttttaaggtaacagtcaaggagaccaaagaatggtacaagttagtcggatacagcgctctgattaaggattaattggttgaactccggaaccctaatcctgccctaggtagttaggcattatttgcaatatattaaagaaaactttgaaaatacgaagtttctattcccagctttgtctggtggccggcatggtcccagcctcctcgctggcgccggctgggcaacattccgaggggaccgtcccctcggtaatggcgaatgggacgcggccgccgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgccagtgaattgtaatacgactcactatagggtgtttggtctgatgaggccgaaaggccgaaactccgtaaggagtc

SEQ ID NO: 14 - DNA, 20678 bp, Artificial Sequence
  p(+)MV323-pMag-nMaghigh
accaaacaaagttgggtaaggatagatcaatcaatgatcatattctagtacacttaggattcaagatcctattatcagggacaagagcaggattagggatatccgagggcgcgccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaagacgtcgagaggccgaggaccagaacaacatccgcctaccctccatcattgttataaaaaacttaggaaccaggtccacacagccgccagccaaccaaccatccactcccacgactggagttcgaacgagatggccacacttttgaggagcttagcattgttcaaaagaaacaaggacaaaccacccattacatcaggatccggtggagccatcagaggaatcaaacacattattatagtaccaattcctggagattcctcaattaccactcgatccagactactggaccggttggtcaggttaattggaaacccggatgtgagcgggcccaaactaacaggggcactaataggtatattatccttatttgtggagtctccaggtcaattgattcagaggatcaccgatgaccctgacgttagcatcaggctgttagaggttgttcagagtgaccagtcacaatctggccttaccttcgcatcaagaggtaccaacatggaggatgaggcggaccaatacttttcacatgatgatccaagcagtagtgatcaatccaggtccggatggttcgagaacaaggaaatctcagatattgaagtgcaagaccctgagggattcaacatgattctgggtaccattctagcccagatctgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctctttacgccgattcatggtggctctaatcctggatatcaagaggacacccgggaacaaacctaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaatctttaccagcaaatgggagaaactgcaccctacatggtaatcctagagaactcaattcagaacaagttcagtgcaggatcataccctctgctctggagctatgccatgggagtaggagtggaacttgaaaactccatgggaggtttgaactttggtcgatcttactttgatccagcatattttagattagggcaagagatggtgaggaggtcagctggaaaggtcagttccacattggcatccgaactcggtatcactgccgaggatgcaaggcttgtttcagagattgcaatgcatactactgaggacaggatcagtagagcggtcggacccagacaagcccaagtgtcatttctacacggtgatcaaagtgagaatgagctaccaggattggggggcaaggaagataggagggtcaaacagggtcggggagaagccagggagagctacagagaaaccgggtccagcagagcaagtgatgcgagagctgcccatcctccaaccagcatgcccctagacattgacactgcatcggagtcaggccaagatccgcaggacagtcgaaggtcagctgacgccctgctcaggctgcaagccatggcaggaatcttggaagaacaaggctcagacacggacacccctagggtatacaatgacagagatcttctagactaggtgcgagaggccgaggaccagaacaacatccgcctaccctccatcattgttataaaaaacttaggaaccaggtccacacagccgccagccaaccaaccatccactcccacgactggagccgatggcagaagagcaggcacgccatgtcaaaaacggactggaatgcatccgggctctcaaggccgagcccatcggctcactggccgtcgaggaagccatggcagcatggtcagaaatatcagacaacccaggacaggaccgagccacctgcaaggaagaggaggcaggcagttcgggtctcagcaaaccatgcctctcagcaattggatcaactgaaggcggtgcacctcgcatccgcggtcagggatctggagaaagcgatgacgacgctgaaactttgggaatcccctcaagaaatctccaggcatcaagcactgggttacagtgttatcatgtttatgatcacagcggtgaagcggttaagggaatccaagatgctgactctatcatggttcaatcaggccttgatggtgatagcaccctctcaggaggagacgatgaatctgaaaacagcgatgtggatattggcgaacctgataccgagggatatgctatcactgaccggggatctgctcccatctctatggggttcagggcttctgatgttgaaactgcagaaggaggggagatccacgagctcctgaaactccaatccagaggcaacaactttccgaagcttgggaaaactctcaatgttcctccgcccccgaaccccagtagggccagcacttccgagacacccattaaaaagggcacagacgcgagattggcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctccgatgtccaagacatcaaaacagccttggccaaaatacacgaggataatcagaagataatctccaagctagaatcattgctgttattgaagggagaagttgagtcaattaagaagcagatcaacaggcaaaatatcagcatatccaccctggaaggacacctctcaagcatcatgattgccattcctggacttgggaaggatcccaacgaccccactgcagatgtcgaactcaatcccgacctgaaacccatcataggcagagattcaggccgagcactggccgaagttctcaagaagcccgttgccagccgacaactccagggaatgactaatggacggaccagttccagaggacagctgctgaaggaatttcaactaaagccgatcgggaaaaaggtgagctcagccgtcgggtttgttcctgacaccggccctgcatcacgcagtgtaatccgctccattataaaatccagccggctagaggaggatcggaagcgttacctgatgactctccttgatgatatcaaaggagccaacgatcttgccaagttccaccagatgctgatgaagataataatgaagtagctacagctcaacttacctgccaaccccatgccagtcgacctaattagtacaacctaaatccattataaaaaacttaggagcaaagtgattgcctcctaagttccacaatgacagagatctacgatttcgacaagtcggcatgggacatcaaagggtcgatcgctccgatacaacctaccacctacagtgatggcaggctggtgccccaggtcagagtcatagatcctggtctaggtgataggaaggatgaatgctttatgtacatgtttctgctgggggttgttgaggacagcgatcccctagggcctccaatcgggcgagcattcgggtccctgcccttaggtgttggtagatccacagcaaaacccgaggaactcctcaaagaggccactgagcttgacatagttgttagacgtacagcagggctcaatgaaaaactggtgttctacaacaacaccccactaaccctcctcacaccttggagaaaggtcctaacaacagggagtgtcttcaatgcaaaccaagtgtgcaatgcggttaatctaataccgctggacaccccgcagaggttccgtgttgtttatatgagcatcacccgtctttcggataacgggtattacaccgttcccagaagaatgctggaattcagatcggtcaatgcagtggccttcaacctgctagtgacccttaggattgacaaggcgattggccctgggaagatcatcgacaatgcagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccactgatggatatcaatgaagaccttaatcggttactctggaggagcagatgcaagatagtaagaatccaggcagttttgcagccatcagttcctcaagaattccgcatttacgacgacgtgatcataaatgatgaccaaggactattcaaagttctgtagaccgcagtgcccagcaatacccgaaaacgacccccctcataatgacagccagaaggcccggacaaaaaagccccctccagaagactccacggaccaagcgagaggccagccagcagccgacagcaagtgtggacaccaggcggcccaagcacagaacagccccgacacaaggccaccaccagccatcccaatctgcgtcctcctcgtgggacccccgaggaccaaccccgaaggtcgctccgaacacagaccaccaaccgcatccccacagctcccgggaaaggaacccccagcaactggaaggcccctccccccctcccccaacgcaagaaccccacaaccgaaccgcacaagcgaccgaggtgacccaaccgcaggcatccgactccttagacagatcctctccccccggcatactaaacaaaacttagggccaaggaacacacacactcgacagaacccagaccccggcccgcggcaccgcgcccccaccccccgaaaaccagagggagcccccaaccaaacccgccggcccccccggtgcccacaggtaggcacaccaacccccgaccagacccagcacccagccaccgacaatccaagacggggggccccccccaaaaaaaggcccccaggggccgacagccagcatcgcgaggaagcacacccaccccacacacgaccacggcaaccgaaccagagtccagaccaccctgggccaccagctcccagactcggccatcaccccgcaaaaaggaaaggccacaacccgcgcaccccagccccgatccggcgggcagccactcaacccgaaccagcacccaagagcgatccctgggggacccccaaaccgcaaaagacatcagtatcccacagcctctccaagtcccccggtctcctcctcttctcgaagggaccaaaagatcaatccaccacatccgacgacactcaattccccacccccaaaggagacaccgggaatcccagaatcaagactcatccagtgtccatcatgggtctcaaggtgaacgtctctgccatattcatggcagtactgttaactctccaaacacccaccggtcaaatccattggggcaatctctctaagataggggtggtagggataggaagtgcaagctacaaagttatgactcgttccagccatcaatcattggtcataaaattaatgcccaatataactctcctcaataactgcacgagggtagagatcgcagaatacaggagactactgagaacagttttggaaccaattagagatgcacttaatgcaatgacccagaatataagaccggttcagagtgtagcttcaagtaggagacacaagagatttgcgggagttgtcctggcaggtgcggccctaggcgttgccacagctgctcagataacagccggcattgcacttcaccagtccatgctgaactctcaagccatcgacaatctgagagcaagcctggaaactactaatcaggcaattgaggcaatcagacaagcagggcaggagatgatattggctgttcagggtgtccaagactacatcaataatgagctgataccgtctatgaaccaactatcttgtgatttaatcggccagaagctagggctcaaattgctcagatactatacagaaatcctgtcattatttggccccagcttacgggaccccatatctgcggagatatccatccaggctttgagctatgcgcttggaggagatatcaataaggtattagaaaagctcggatacagtggaggtgatttactgggcatcttagagagcagaggaataaaggcccggataactcacgtcgacacagagtcctacttcattgtactcagtatagcctatccgacgctgtccgagattaagggggtgattgtccaccggctagagggggtctcgtacaatataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtccaccaagtcctgtgctcgtacactcgtatccgggtcttttgggaaccggttcattttatcacaagggaacctaatagccaattgtgcatcaatcctctgcaagtgttacacaacaggaacgatcattaatcaagaccctgacaagatcctaacatacattgctgccgatcactgcccggtggtcgaggtgaacggtgtgaccatccaagtcgggagcaggaggtatccggacgcggtgtacctgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtttacatcctgattgcagtgtgtcttggagggttgatagggatccccgctttaatatgttgctgcagggggcgctgtaacaaaaagggagaacaagttggtatgtcaagaccaggcctaaagcctgatcttacagggacatcaaaatcctatgtaaggtcgctctgatcctctacaactcttgaaacacagatttcccacaagtctcctcttcgtcatcaagcaaccaccgcatccagcatcaagcccacctgaaattgtctccggcttccctctggccgaacgatatcggtagttaattaaaacttagggtgcaagatcatccacaatgtcaccacaacgagaccgaataaatgccttctacaaagacaacccacatcctaagggaagtaggatagttattaacagagaacatcttatgattgatagaccttatgttttgctggctgttctattcgtcatgtttctgagcttgatcgggttgctagccattgcaggcattagactccatcgtgcagccatctacaccgcagagatccataagagcctcagcaccaatctagatgtaactaactcgatcgagcatcaggtcaaggacgtgctgacaccactcttcaagatcattggtgatgaagtgggcctgaggacacctcagagattcactgacctagtgaaattcatctctgacaaaattaaattccttaatccggatagggagtacgacttcagagatctcacttggtgtatcaacccgccagagagaatcaaattggattatgatcaatactgtgcagatgtggctgctgaagaactcatgaatgcattggtgaactcaactctactggaggccagggcaaccaatcagttcctagctgtctcaaagggaaactgctcagggcccactacaatcagaggtcaattctcaaacatgtcgctgtccctgttggacttgtatttaagtcgaggttacaatgtgtcatctatagtcactatgacatcccagggaatgtacgggggaacttacctagtgggaaagcctaatctgagcagtaaagggtcagagttgtcacaactgagcatgcaccgagtgtttgaagtaggggttatcagaaatccgggtttgggggctccggtgttccatatgacaaactattttgagcaaccagtcagtaatgatttcagcaactgcatggtggctttgggggagcttaaattcgcagccctctgtcacagggaagattctatcacaattccctatcaggggtcagggaaaggtgtcagcttccagctcgtcaagctaggtgtctggaaatccccaaccgacatgcgatcctgggtccccctatcaacggatgatccagtgatagataggctttatctctcatctcacagaggtgttatcgctgacaatcaagcaaaatgggctgtcccgacaacacggacagatgacaagttgcgaatggagacatgcttccagcaggcgtgtaagggtaaaaaccaagcactctgcgagaatcccgagtgggcaccattgaaggataacaggattccttcatacggggtcttgtctgttaatctgagtctgacagttgagcttaaaatcaaaattgcttcaggattcgggccattgatcacacacggttcagggatggacctatacaaaaccaaccacaacaatgtgtattggctgactatcccgccaatgaagaacctagccttaggtgtaatcaacacattggagtggataccgagattcaaggttagtcccaacctcttcactgttccaatcaaggaagcaggcgaggactgccatgccccaacatacctacctgcggaggtggatggtgatgtcaaactcagttccaatctggtaattctacctggtcaggatctccaatatgttttggcaacctacgatacttccagggttgaacatgctgtggtttattatgtttacagcccaagccgctcattttcttacttttatccttttaggttgcctataaagggggtcccaatcgaattacaagtggaatgcttcacatgggacaaaaaactctggtgccgtcacttctgtgtgcttgcggactcagaatctggtggacatatcactcactctgggatggtgggcatgggagtcagctgcacagtcactcgggaagatggaaccaatcgcagatagggctgccagtgaaccgatcacatgatgtcacccagacatcaggcatacccactagtgtgaaatagacatcagaattaagaaaaacgtagggtccaagtggtttcccgttatggactcgctatctgtcaaccagatcttataccctgaagttcacctagatagcccgatagttaccaataagatagtagctatcctggagtatgctcgagtccctcacgcttacagcctggaggaccctacactgtgtcagaacatcaagcaccgcctaaaaaacggattctccaaccaaatgattataaacaatgtggaagttgggaatgtcatcaagtccaagcttaggagttatccggcccactctcatattccatatccaaattgtaatcaggatttatttaacatagaagacaaagagtcaacaaggaagatccgtgagctcctaaaaaagggaaattcgctgtactccaaagtcagtgataaggttttccaatgcctgagggacactaactcacggcttggcctaggctccgaattgagggaggacatcaaggagaaaattattaacttgggagtttacatgcacagctcccaatggtttgagccctttctgttttggtttacagtcaagactgagatgaggtcagtgattaaatcacaaacccatacttgccataggaggagacacacacctgtattcttcactggtagttcagttgagctgttaatctctcgtgaccttgttgctataatcagtaaggaatctcaacatgtatattacctgacgtttgaactggttttgatgtattgtgatgtcatagaggggaggttaatgacagagaccgctatgaccattgatgctaggtatgcagaacttctaggaagagtcagatacatgtggaaactgatagatggtttcttccctgcactcgggaatccaacttatcaaattgtagccatgctggagccactttcacttgcttacctgcaactgagggatataacagtagaactcagaggtgctttccttaaccactgctttactgaaatacatgatgttcttgaccaaaacgggttttctgatgaaggtacttatcatgagttaattgaagccctagattacattttcataactgatgacatacatctgacaggggagattttctcatttttcagaagtttcggccaccccagacttgaagcagtaacggctgctgaaaatgtcaggaaatacatgaatcagcctaaagtcattgtgtatgagactctgatgaaaggtcatgccatattttgtggaatcataatcaacggctatcgtgacaggcacggaggcagttggccacccctgaccctccccctgcatgctgcagacacaatccggaatgctcaagcttcaggtgaagggttaacacatgagcagtgcgttgataactggaaatcatttgctggagtgagatttggctgttttatgcctcttagcctggacagtgatctgacaatgtacctaaaggacaaggcacttgctgctctccaaagggaatgggattcagtttacccgaaagagttcctgcgttacgatcctcccaagggaaccgggtcacggaggcttgtagatgttttccttaatgattcgagctttgacccatatgatatgataatgtatgtcgtaagtggagcctacctccatgaccctgagttcaacctgtcttacagcctgaaagaaaaggagatcaaggaaacaggtagacttttcgctaaaatgacttacaaaatgagggcatgccaagtgatcgctgaaaatctaatctcaaacgggattggcaagtattttaaggacaatgggatggccaaggatgagcacgatttgactaaggcactccacactctggctgtctcaggagtccccaaagatctcaaagaaagtcacaggggggggccagtcttaaaaacctactcccgaagcccagtccacacaagtaccaggaacgttaaagcagaaaaagggtttgtaggattccctcatgtaattcggcagaatcaagacactgatcatccggagaatatagaaacctacgagacagtcagcgcatttatcacgactgatctcaagaagtactgccttaattggagatatgagaccatcagcttatttgcacagaggctaaatgagatttacggattaccctcattttttcagtggctgcataagaggcttgaaacctctgtcctctatgtaagtgaccctcattgcccccccgaccttgacgcccatgtcccgttatgcaaagtccccaatgaccaaatcttcatcaagtaccctatgggaggtatagaagggtattgtcagaagctgtggaccatcagcaccattccctacttatacctggctgcttatgagagcggggtaaggattgcttcgttagtgcaaggggacaatcagaccatagccgtaacaaaaagggtacccagcacatggccttacaaccttaagaaacgggaagctgctagagtaactagagattactttgtaattcttaggcaaaggctacatgacattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcggcatgcagtaatattgctacaacaatggccaaaagcattgagagaggttatgaccgttatcttgcatattccctgaacgtcctaaaagtgatacagcaaattttgatctcccttggcttcacaatcaattcaaccatgacccgggatgtagtcatacccctcctcacaaacaacgatctcttaataaggatggcactgttgcccgctcctattgggggtatgaattatctgaatatgagcaggctgtttgtcagaaacatcggtgatccagtaacatcatcaattgctgatctcaagagaatgattctcgcatcactaatgcctgaagagaccctccatcaagtaatgacacaacaaccgggggactcttcattcctagactgggctagcgacccttactcagcaaatcttgtatgcgtccagagcatcactagactcctcaagaacataactgcaaggtttgtcctgatccacagtccaaacccaatgttaaaagggttattccatgatgacagcaaagaagaggacgagagactggcggcattcctcatggacaggcatattatagtacctagggcagctcatgaaatcctggatcatagtgtcacaggggcaagagagtctattgcaggcatgctagataccacaaaaggcctgattcgagccagcatgaggaagggggggttaacctctcgagtgataaccagattgtccaattatgactatgaacaatttagagcagggatggtgctattgacaggaagaaagagaaatgtcctcattgacaaagagtcatgttcagtgcagctggctagagccctaagaagccatatgtgggcaagactagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagctcgccttcgtaagagccccaagtagatccttgcgatctgccgttagaatagcaacagtgtactcatgggcttacggtgatgatgatagctcttggaacgaagcctggttgttggcaaggcaaagggccaatgtgagcctggaggagctaagggtgatcactcccatctcgacttcgactaatttagcgcataggttgagggatcgtagcactcaagtgaaatactcaggtacatcccttgtccgagtggcaaggtataccacaatctccaacgacaatctctcatttgtcatatcagataagaaggttgatactaactttatataccaacaaggaatgcttctagggttgggtgttttagaaacattgtttcgactcgagaaagatactggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattctagctaagtccacagcactatctatgattgacctggtaacaaaatttgagaaggaccatatgaatgaaatttcagctctcataggggatgacgatatcaatagtttcataactgagtttctgcttatagagccaagattattcaccatctacttgggccagtgtgcagccatcaattgggcatttgatgtacattatcatagaccatcagggaaatatcagatgggtgagctgttgtcttcgttcctttctagaatgagcaaaggagtgtttaaggtgcttgtcaatgctctaagccacccaaagatctacaagaaattctggcattgtggtattatagagcctatccatggtccttcacttgatgctcaaaacttgcacacaactgtgtgcaacatggtttacacatgctatatgacctacctcgacctgttgttgaatgaagagttagaagagttcacatttcttttgtgtgaaagcgatgaggatgtagtaccggacagattcgacaacatccaggcaaaacacttgtgtgttctggcagatttgtactgtcaaccagggacctgcccaccgattcgaggtctaaggccggtagagaaatgtgcagttctaaccgatcatatcaaggcagaggctaggttatctccagcaggatcttcgtggaacataaatccaattattgtagaccattactcatgctctctgacttatctccgtcgaggatctatcaaacagataagattgagagttgatccaggattcatttttgacgccctcgctgaggtaaatgtcagtcagccaaaggtcggcagcgacgtcagccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaaaccggtaattccgctgacggcggcggaggatcgggtggtagtggtggttcaggaggaggatcgacccaaggaggatccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatccgcaaggcaatcgacaggaatgccgaggtgcaggttgaagtagtcaattttaaaaagaatggacagcgatttgttaatttcctgactatcatacctgttagggacgaaacaggcgagtatcgatactctatgggattccagtgcgaaacagaatatccgtacgacgtcccagattacgcgggcatctcaaatatgagcatcaaggatttcagacctccacacgatgatgttgcaaaattgctcaaagatatcaacacaagcaagcacaatcttcccatttcagggggtagtctcgccaattatgaaatccatgctttccgcagaatcgggttaaactcatctgcttgctacaaagctgttgagatatcaacattaattaggagatgccttgagccaggggaagacggcttgttcttgggtgaggggtcgggttctatgttgatcacttataaggagatactaaaactaaacaagtgcttctataatagtggggtttccgccaattctagatctggtcaaagggaattagcaccctatccctccgaagttggccttgtcgaacacagaatgggagtaggtaatattgtcaaggtgctctttaacgggaggcccgaagtcacgtgggtaggcagtatagattgcttcaatttcatagtcagtaatatccctacctctagtgtggggtttatccattcagatatagagaccttacctaacaaagatactatagagaagctagaggaattggcagccatcttatcgatggctctactccttggcaaaataggatcaatactggtgattaagcttatgcctttcagcggggattttgttcagggatttataagctatgtagggtctcattatagagaagtgaaccttgtctaccctaggtacagcaacttcatatctactgaatcttatttagttatgacagatctcaaagctaaccggctaatgaatcctgaaaagatcaagcagcagataattgaatcatctgtacggacttcacctggacttataggtcacatcctatccattaagcaactaagctgcatacaagcaattgtgggaggcgcggttagtagaggtgatatcaaccctattctgaaaaaacttacacctatagagcaggtgctgatcagttgcgggttggcaattaacggacctaaactgtgcaaagaattaatccaccatgatgttgcctcagggcaagatggattgcttaactctatactcatcctctacagggagttggcaagattcaaagacaaccaaagaagtcaacaagggatgttccacgcttaccccgtattggtaagtagtaggcaacgagaacttgtatctaggatcactcgcaaattttgggggcatattcttctttactccgggaacagaaagttgataaatcggtttatccagaatctcaagtccggttatctagtactagacttacaccagaatatcttcgttaagaatctatccaagtcagagaaacagattattatgacggggggtttaaaacgtgagtgggtttttaaggtaacagtcaaggagaccaaagaatggtacaagttagtcggatacagcgctctgattaaggattaattggttgaactccggaaccctaatcctgccctaggtagttaggcattatttgcaatatattaaagaaaactttgaaaatacgaagtttctattcccagctttgtctggtggccggcatggtcccagcctcctcgctggcgccggctgggcaacattccgaggggaccgtcccctcggtaatggcgaatgggacgcggccgccgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgccagtgaattgtaatacgactcactata

SEQ ID NO: 15 - DNA, 22118 bp, Artificial Sequence
  p(+)MV323-CRY2-CIB1N
accaaacaaagttgggtaaggatagatcaatcaatgatcatattctagtacacttaggattcaagatcctattatcagggacaagagcaggattagggatatccgagggcgcgccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaagacgtcgagaggccgaggaccagaacaacatccgcctaccctccatcattgttataaaaaacttaggaaccaggtccacacagccgccagccaaccaaccatccactcccacgactggagttcgaacgagatggccacacttttgaggagcttagcattgttcaaaagaaacaaggacaaaccacccattacatcaggatccggtggagccatcagaggaatcaaacacattattatagtaccaattcctggagattcctcaattaccactcgatccagactactggaccggttggtcaggttaattggaaacccggatgtgagcgggcccaaactaacaggggcactaataggtatattatccttatttgtggagtctccaggtcaattgattcagaggatcaccgatgaccctgacgttagcatcaggctgttagaggttgttcagagtgaccagtcacaatctggccttaccttcgcatcaagaggtaccaacatggaggatgaggcggaccaatacttttcacatgatgatccaagcagtagtgatcaatccaggtccggatggttcgagaacaaggaaatctcagatattgaagtgcaagaccctgagggattcaacatgattctgggtaccattctagcccagatctgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctctttacgccgattcatggtggctctaatcctggatatcaagaggacacccgggaacaaacctaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaatctttaccagcaaatgggagaaactgcaccctacatggtaatcctagagaactcaattcagaacaagttcagtgcaggatcataccctctgctctggagctatgccatgggagtaggagtggaacttgaaaactccatgggaggtttgaactttggtcgatcttactttgatccagcatattttagattagggcaagagatggtgaggaggtcagctggaaaggtcagttccacattggcatccgaactcggtatcactgccgaggatgcaaggcttgtttcagagattgcaatgcatactactgaggacaggatcagtagagcggtcggacccagacaagcccaagtgtcatttctacacggtgatcaaagtgagaatgagctaccaggattggggggcaaggaagataggagggtcaaacagggtcggggagaagccagggagagctacagagaaaccgggtccagcagagcaagtgatgcgagagctgcccatcctccaaccagcatgcccctagacattgacactgcatcggagtcaggccaagatccgcaggacagtcgaaggtcagctgacgccctgctcaggctgcaagccatggcaggaatcttggaagaacaaggctcagacacggacacccctagggtatacaatgacagagatcttctagactaggtgcgagaggccgaggaccagaacaacatccgcctaccctccatcattgttataaaaaacttaggaaccaggtccacacagccgccagccaaccaaccatccactcccacgactggagccgatggcagaagagcaggcacgccatgtcaaaaacggactggaatgcatccgggctctcaaggccgagcccatcggctcactggccgtcgaggaagccatggcagcatggtcagaaatatcagacaacccaggacaggaccgagccacctgcaaggaagaggaggcaggcagttcgggtctcagcaaaccatgcctctcagcaattggatcaactgaaggcggtgcacctcgcatccgcggtcagggatctggagaaagcgatgacgacgctgaaactttgggaatcccctcaagaaatctccaggcatcaagcactgggttacagtgttatcatgtttatgatcacagcggtgaagcggttaagggaatccaagatgctgactctatcatggttcaatcaggccttgatggtgatagcaccctctcaggaggagacgatgaatctgaaaacagcgatgtggatattggcgaacctgataccgagggatatgctatcactgaccggggatctgctcccatctctatggggttcagggcttctgatgttgaaactgcagaaggaggggagatccacgagctcctgaaactccaatccagaggcaacaactttccgaagcttgggaaaactctcaatgttcctccgcccccgaaccccagtagggccagcacttccgagacacccattaaaaagggcacagacgcgagattggcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctccgatgtccaagacatcaaaacagccttggccaaaatacacgaggataatcagaagataatctccaagctagaatcattgctgttattgaagggagaagttgagtcaattaagaagcagatcaacaggcaaaatatcagcatatccaccctggaaggacacctctcaagcatcatgattgccattcctggacttgggaaggatcccaacgaccccactgcagatgtcgaactcaatcccgacctgaaacccatcataggcagagattcaggccgagcactggccgaagttctcaagaagcccgttgccagccgacaactccagggaatgactaatggacggaccagttccagaggacagctgctgaaggaatttcaactaaagccgatcgggaaaaaggtgagctcagccgtcgggtttgttcctgacaccggccctgcatcacgcagtgtaatccgctccattataaaatccagccggctagaggaggatcggaagcgttacctgatgactctccttgatgatatcaaaggagccaacgatcttgccaagttccaccagatgctgatgaagataataatgaagtagctacagctcaacttacctgccaaccccatgccagtcgacctaattagtacaacctaaatccattataaaaaacttaggagcaaagtgattgcctcctaagttccacaatgacagagatctacgatttcgacaagtcggcatgggacatcaaagggtcgatcgctccgatacaacctaccacctacagtgatggcaggctggtgccccaggtcagagtcatagatcctggtctaggtgataggaaggatgaatgctttatgtacatgtttctgctgggggttgttgaggacagcgatcccctagggcctccaatcgggcgagcattcgggtccctgcccttaggtgttggtagatccacagcaaaacccgaggaactcctcaaagaggccactgagcttgacatagttgttagacgtacagcagggctcaatgaaaaactggtgttctacaacaacaccccactaaccctcctcacaccttggagaaaggtcctaacaacagggagtgtcttcaatgcaaaccaagtgtgcaatgcggttaatctaataccgctggacaccccgcagaggttccgtgttgtttatatgagcatcacccgtctttcggataacgggtattacaccgttcccagaagaatgctggaattcagatcggtcaatgcagtggccttcaacctgctagtgacccttaggattgacaaggcgattggccctgggaagatcatcgacaatgcagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccactgatggatatcaatgaagaccttaatcggttactctggaggagcagatgcaagatagtaagaatccaggcagttttgcagccatcagttcctcaagaattccgcatttacgacgacgtgatcataaatgatgaccaaggactattcaaagttctgtagaccgcagtgcccagcaatacccgaaaacgacccccctcataatgacagccagaaggcccggacaaaaaagccccctccagaagactccacggaccaagcgagaggccagccagcagccgacagcaagtgtggacaccaggcggcccaagcacagaacagccccgacacaaggccaccaccagccatcccaatctgcgtcctcctcgtgggacccccgaggaccaaccccgaaggtcgctccgaacacagaccaccaaccgcatccccacagctcccgggaaaggaacccccagcaactggaaggcccctccccccctcccccaacgcaagaaccccacaaccgaaccgcacaagcgaccgaggtgacccaaccgcaggcatccgactccttagacagatcctctccccccggcatactaaacaaaacttagggccaaggaacacacacactcgacagaacccagaccccggcccgcggcaccgcgcccccaccccccgaaaaccagagggagcccccaaccaaacccgccggcccccccggtgcccacaggtaggcacaccaacccccgaccagacccagcacccagccaccgacaatccaagacggggggccccccccaaaaaaaggcccccaggggccgacagccagcatcgcgaggaagcacacccaccccacacacgaccacggcaaccgaaccagagtccagaccaccctgggccaccagctcccagactcggccatcaccccgcaaaaaggaaaggccacaacccgcgcaccccagccccgatccggcgggcagccactcaacccgaaccagcacccaagagcgatccctgggggacccccaaaccgcaaaagacatcagtatcccacagcctctccaagtcccccggtctcctcctcttctcgaagggaccaaaagatcaatccaccacatccgacgacactcaattccccacccccaaaggagacaccgggaatcccagaatcaagactcatccagtgtccatcatgggtctcaaggtgaacgtctctgccatattcatggcagtactgttaactctccaaacacccaccggtcaaatccattggggcaatctctctaagataggggtggtagggataggaagtgcaagctacaaagttatgactcgttccagccatcaatcattggtcataaaattaatgcccaatataactctcctcaataactgcacgagggtagagatcgcagaatacaggagactactgagaacagttttggaaccaattagagatgcacttaatgcaatgacccagaatataagaccggttcagagtgtagcttcaagtaggagacacaagagatttgcgggagttgtcctggcaggtgcggccctaggcgttgccacagctgctcagataacagccggcattgcacttcaccagtccatgctgaactctcaagccatcgacaatctgagagcaagcctggaaactactaatcaggcaattgaggcaatcagacaagcagggcaggagatgatattggctgttcagggtgtccaagactacatcaataatgagctgataccgtctatgaaccaactatcttgtgatttaatcggccagaagctagggctcaaattgctcagatactatacagaaatcctgtcattatttggccccagcttacgggaccccatatctgcggagatatccatccaggctttgagctatgcgcttggaggagatatcaataaggtattagaaaagctcggatacagtggaggtgatttactgggcatcttagagagcagaggaataaaggcccggataactcacgtcgacacagagtcctacttcattgtactcagtatagcctatccgacgctgtccgagattaagggggtgattgtccaccggctagagggggtctcgtacaatataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtccaccaagtcctgtgctcgtacactcgtatccgggtcttttgggaaccggttcattttatcacaagggaacctaatagccaattgtgcatcaatcctctgcaagtgttacacaacaggaacgatcattaatcaagaccctgacaagatcctaacatacattgctgccgatcactgcccggtggtcgaggtgaacggtgtgaccatccaagtcgggagcaggaggtatccggacgcggtgtacctgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtttacatcctgattgcagtgtgtcttggagggttgatagggatccccgctttaatatgttgctgcagggggcgctgtaacaaaaagggagaacaagttggtatgtcaagaccaggcctaaagcctgatcttacagggacatcaaaatcctatgtaaggtcgctctgatcctctacaactcttgaaacacagatttcccacaagtctcctcttcgtcatcaagcaaccaccgcatccagcatcaagcccacctgaaattgtctccggcttccctctggccgaacgatatcggtagttaattaaaacttagggtgcaagatcatccacaatgtcaccacaacgagaccgaataaatgccttctacaaagacaacccacatcctaagggaagtaggatagttattaacagagaacatcttatgattgatagaccttatgttttgctggctgttctattcgtcatgtttctgagcttgatcgggttgctagccattgcaggcattagactccatcgtgcagccatctacaccgcagagatccataagagcctcagcaccaatctagatgtaactaactcgatcgagcatcaggtcaaggacgtgctgacaccactcttcaagatcattggtgatgaagtgggcctgaggacacctcagagattcactgacctagtgaaattcatctctgacaaaattaaattccttaatccggatagggagtacgacttcagagatctcacttggtgtatcaacccgccagagagaatcaaattggattatgatcaatactgtgcagatgtggctgctgaagaactcatgaatgcattggtgaactcaactctactggaggccagggcaaccaatcagttcctagctgtctcaaagggaaactgctcagggcccactacaatcagaggtcaattctcaaacatgtcgctgtccctgttggacttgtatttaagtcgaggttacaatgtgtcatctatagtcactatgacatcccagggaatgtacgggggaacttacctagtgggaaagcctaatctgagcagtaaagggtcagagttgtcacaactgagcatgcaccgagtgtttgaagtaggggttatcagaaatccgggtttgggggctccggtgttccatatgacaaactattttgagcaaccagtcagtaatgatttcagcaactgcatggtggctttgggggagcttaaattcgcagccctctgtcacagggaagattctatcacaattccctatcaggggtcagggaaaggtgtcagcttccagctcgtcaagctaggtgtctggaaatccccaaccgacatgcgatcctgggtccccctatcaacggatgatccagtgatagataggctttatctctcatctcacagaggtgttatcgctgacaatcaagcaaaatgggctgtcccgacaacacggacagatgacaagttgcgaatggagacatgcttccagcaggcgtgtaagggtaaaaaccaagcactctgcgagaatcccgagtgggcaccattgaaggataacaggattccttcatacggggtcttgtctgttaatctgagtctgacagttgagcttaaaatcaaaattgcttcaggattcgggccattgatcacacacggttcagggatggacctatacaaaaccaaccacaacaatgtgtattggctgactatcccgccaatgaagaacctagccttaggtgtaatcaacacattggagtggataccgagattcaaggttagtcccaacctcttcactgttccaatcaaggaagcaggcgaggactgccatgccccaacatacctacctgcggaggtggatggtgatgtcaaactcagttccaatctggtaattctacctggtcaggatctccaatatgttttggcaacctacgatacttccagggttgaacatgctgtggtttattatgtttacagcccaagccgctcattttcttacttttatccttttaggttgcctataaagggggtcccaatcgaattacaagtggaatgcttcacatgggacaaaaaactctggtgccgtcacttctgtgtgcttgcggactcagaatctggtggacatatcactcactctgggatggtgggcatgggagtcagctgcacagtcactcgggaagatggaaccaatcgcagatagggctgccagtgaaccgatcacatgatgtcacccagacatcaggcatacccactagtgtgaaatagacatcagaattaagaaaaacgtagggtccaagtggtttcccgttatggactcgctatctgtcaaccagatcttataccctgaagttcacctagatagcccgatagttaccaataagatagtagctatcctggagtatgctcgagtccctcacgcttacagcctggaggaccctacactgtgtcagaacatcaagcaccgcctaaaaaacggattctccaaccaaatgattataaacaatgtggaagttgggaatgtcatcaagtccaagcttaggagttatccggcccactctcatattccatatccaaattgtaatcaggatttatttaacatagaagacaaagagtcaacaaggaagatccgtgagctcctaaaaaagggaaattcgctgtactccaaagtcagtgataaggttttccaatgcctgagggacactaactcacggcttggcctaggctccgaattgagggaggacatcaaggagaaaattattaacttgggagtttacatgcacagctcccaatggtttgagccctttctgttttggtttacagtcaagactgagatgaggtcagtgattaaatcacaaacccatacttgccataggaggagacacacacctgtattcttcactggtagttcagttgagctgttaatctctcgtgaccttgttgctataatcagtaaggaatctcaacatgtatattacctgacgtttgaactggttttgatgtattgtgatgtcatagaggggaggttaatgacagagaccgctatgaccattgatgctaggtatgcagaacttctaggaagagtcagatacatgtggaaactgatagatggtttcttccctgcactcgggaatccaacttatcaaattgtagccatgctggagccactttcacttgcttacctgcaactgagggatataacagtagaactcagaggtgctttccttaaccactgctttactgaaatacatgatgttcttgaccaaaacgggttttctgatgaaggtacttatcatgagttaattgaagccctagattacattttcataactgatgacatacatctgacaggggagattttctcatttttcagaagtttcggccaccccagacttgaagcagtaacggctgctgaaaatgtcaggaaatacatgaatcagcctaaagtcattgtgtatgagactctgatgaaaggtcatgccatattttgtggaatcataatcaacggctatcgtgacaggcacggaggcagttggccacccctgaccctccccctgcatgctgcagacacaatccggaatgctcaagcttcaggtgaagggttaacacatgagcagtgcgttgataactggaaatcatttgctggagtgagatttggctgttttatgcctcttagcctggacagtgatctgacaatgtacctaaaggacaaggcacttgctgctctccaaagggaatgggattcagtttacccgaaagagttcctgcgttacgatcctcccaagggaaccgggtcacggaggcttgtagatgttttccttaatgattcgagctttgacccatatgatatgataatgtatgtcgtaagtggagcctacctccatgaccctgagttcaacctgtcttacagcctgaaagaaaaggagatcaaggaaacaggtagacttttcgctaaaatgacttacaaaatgagggcatgccaagtgatcgctgaaaatctaatctcaaacgggattggcaagtattttaaggacaatgggatggccaaggatgagcacgatttgactaaggcactccacactctggctgtctcaggagtccccaaagatctcaaagaaagtcacaggggggggccagtcttaaaaacctactcccgaagcccagtccacacaagtaccaggaacgttaaagcagaaaaagggtttgtaggattccctcatgtaattcggcagaatcaagacactgatcatccggagaatatagaaacctacgagacagtcagcgcatttatcacgactgatctcaagaagtactgccttaattggagatatgagaccatcagcttatttgcacagaggctaaatgagatttacggattaccctcattttttcagtggctgcataagaggcttgaaacctctgtcctctatgtaagtgaccctcattgcccccccgaccttgacgcccatgtcccgttatgcaaagtccccaatgaccaaatcttcatcaagtaccctatgggaggtatagaagggtattgtcagaagctgtggaccatcagcaccattccctacttatacctggctgcttatgagagcggggtaaggattgcttcgttagtgcaaggggacaatcagaccatagccgtaacaaaaagggtacccagcacatggccttacaaccttaagaaacgggaagctgctagagtaactagagattactttgtaattcttaggcaaaggctacatgacattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcggcatgcagtaatattgctacaacaatggccaaaagcattgagagaggttatgaccgttatcttgcatattccctgaacgtcctaaaagtgatacagcaaattttgatctcccttggcttcacaatcaattcaaccatgacccgggatgtagtcatacccctcctcacaaacaacgatctcttaataaggatggcactgttgcccgctcctattgggggtatgaattatctgaatatgagcaggctgtttgtcagaaacatcggtgatccagtaacatcatcaattgctgatctcaagagaatgattctcgcatcactaatgcctgaagagaccctccatcaagtaatgacacaacaaccgggggactcttcattcctagactgggctagcgacccttactcagcaaatcttgtatgcgtccagagcatcactagactcctcaagaacataactgcaaggtttgtcctgatccacagtccaaacccaatgttaaaagggttattccatgatgacagcaaagaagaggacgagagactggcggcattcctcatggacaggcatattatagtacctagggcagctcatgaaatcctggatcatagtgtcacaggggcaagagagtctattgcaggcatgctagataccacaaaaggcctgattcgagccagcatgaggaagggggggttaacctctcgagtgataaccagattgtccaattatgactatgaacaatttagagcagggatggtgctattgacaggaagaaagagaaatgtcctcattgacaaagagtcatgttcagtgcagctggctagagccctaagaagccatatgtgggcaagactagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagctcgccttcgtaagagccccaagtagatccttgcgatctgccgttagaatagcaacagtgtactcatgggcttacggtgatgatgatagctcttggaacgaagcctggttgttggcaaggcaaagggccaatgtgagcctggaggagctaagggtgatcactcccatctcgacttcgactaatttagcgcataggttgagggatcgtagcactcaagtgaaatactcaggtacatcccttgtccgagtggcaaggtataccacaatctccaacgacaatctctcatttgtcatatcagataagaaggttgatactaactttatataccaacaaggaatgcttctagggttgggtgttttagaaacattgtttcgactcgagaaagatactggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattctagctaagtccacagcactatctatgattgacctggtaacaaaatttgagaaggaccatatgaatgaaatttcagctctcataggggatgacgatatcaatagtttcataactgagtttctgcttatagagccaagattattcaccatctacttgggccagtgtgcagccatcaattgggcatttgatgtacattatcatagaccatcagggaaatatcagatgggtgagctgttgtcttcgttcctttctagaatgagcaaaggagtgtttaaggtgcttgtcaatgctctaagccacccaaagatctacaagaaattctggcattgtggtattatagagcctatccatggtccttcacttgatgctcaaaacttgcacacaactgtgtgcaacatggtttacacatgctatatgacctacctcgacctgttgttgaatgaagagttagaagagttcacatttcttttgtgtgaaagcgatgaggatgtagtaccggacagattcgacaacatccaggcaaaacacttgtgtgttctggcagatttgtactgtcaaccagggacctgcccaccgattcgaggtctaaggccggtagagaaatgtgcagttctaaccgatcatatcaaggcagaggctaggttatctccagcaggatcttcgtggaacataaatccaattattgtagaccattactcatgctctctgacttatctccgtcgaggatctatcaaacagataagattgagagttgatccaggattcatttttgacgccctcgctgaggtaaatgtcagtcagccaaaggtcggcagcgacgtcaagatggacaaaaagactatagtttggtttagaagagacctaaggattgaggataatcctgcattagcagcagctgctcacgaaggatctgtttttcctgtcttcatttggtgtcctgaagaagaaggacagttttatcctggaagagcttcaagatggtggatgaaacaatcacttgctcacttatctcaatccttgaaggctcttggatctgacctcactttaatcaaaacccacaacacgatttcagcgatcttggattgtatccgcgttaccggtgctacaaaagtcgtctttaaccacctctatgatcctgtttcgttagttcgggaccataccgtaaaggagaagctggtggaacgtgggatctctgtgcaaagctacaatggagatctattgtatgaaccgtgggagatatactgcgaaaagggcaaaccttttacgagtttcaattcttactggaagaaatgcttagatatgtcgattgaatccgttatgcttcctcctccttggcggttgatgccaataactgcagcggctgaagcgatttgggcgtgttcgattgaagaactagggctggagaatgaggccgagaaaccgagcaatgcgttgttaactagagcttggtctccaggatggagcaatgctgataagttactaaatgagttcatcgagaagcagttgatagattatgcaaagaacagcaagaaagttgttgggaattctacttcactactttctccgtatctccatttcggggaaataagcgtcagacacgttttccagtgtgcccggatgaaacaaattatatgggcaagagataagaacagtgaaggagaagaaagtgcagatctttttcttaggggaatcggtttaagagagtattctcggtatatatgtttcaacttcccgtttactcacgagcaatcgttgttgagtcatcttcggtttttcccttgggatgctgatgttgataagttcaaggcctggagacaaggcaggaccggttatccgttggtggatgccggaatgagagagctttgggctaccggatggatgcataacagaataagagtgattgtttcaagctttgctgtgaagtttcttctccttccatggaaatggggaatgaagtatttctgggatacacttttggatgctgatttggaatgtgacatccttggctggcagtatatctctgggagtatccccgatggccacgagcttgatcgcttggacaatcccgcgttacaaggcgccaaatatgacccagaaggtgagtacataaggcaatggcttcccgagcttgcgagattgccaactgaatggatccatcatccatgggacgctcctttaaccgtactcaaagcttctggtgtggaactcggaacaaactatgcgaaacccattgtagacatcgacacagctcgtgagctactagctaaagctatttcaagaacccgtgaagcacagatcatgatcggagcagcacctgatgagattgtagcagatagcttcgaggccttaggggctaataccattaaagaacctggtctttgcccatctgtgtcttctaatgaccaacaagtaccttcggctgttcgttacaacgggtcagcggcagtgaaacctgaggaagaagaagagagagacatgaagaaatctaggggattcgatgaaagggagttgttttcgactgctgaatcttcttcttcttcgagtgtgtttttcgtttcgcagtcttgctcgttggcatcagaagggaagaatctggaaggtattcaagattcatctgatcagattactacaagtttgggaaaaaatggttgcaaaaccggtaattccgctgacggcggcggaggatcgggtggtagtggtggttcaggaggaggatcgacccaaggaggatccatgaatggagctataggaggtgaccttttgctcaattttcctgacatgtcggtcctagagcgccaaagggctcacctcaagtacctcaatcccacctttgattctcctctcgccggcttctttgccgattcttcaatgattaccggcggcgagatggacagctatctttcgactgccggtttgaatcttccgatgatgtacggtgagacgacggtggaaggtgattcaagactctcaatttcgccggaaacgacgcttgggactggaaatttcaaggcagcgaagtttgatacagagactaaggattgtaatgaggcggcgaagaagatgacgatgaacagagatgacctagtagaagaaggagaagaagagaagtcgaaaataacagagcaaaacaatgggagcacaaaaagcatcaagaagatgaaacacaaagccaagaaagaagagaacaatttctctaatgattcatctaaagtgacgaaggaattggagaaaacggattatattggctatccgtacgacgtcccagattacgcgggcatctcaaatatgagcatcaaggatttcagacctccacacgatgatgttgcaaaattgctcaaagatatcaacacaagcaagcacaatcttcccatttcagggggtagtctcgccaattatgaaatccatgctttccgcagaatcgggttaaactcatctgcttgctacaaagctgttgagatatcaacattaattaggagatgccttgagccaggggaagacggcttgttcttgggtgaggggtcgggttctatgttgatcacttataaggagatactaaaactaaacaagtgcttctataatagtggggtttccgccaattctagatctggtcaaagggaattagcaccctatccctccgaagttggccttgtcgaacacagaatgggagtaggtaatattgtcaaggtgctctttaacgggaggcccgaagtcacgtgggtaggcagtatagattgcttcaatttcatagtcagtaatatccctacctctagtgtggggtttatccattcagatatagagaccttacctaacaaagatactatagagaagctagaggaattggcagccatcttatcgatggctctactccttggcaaaataggatcaatactggtgattaagcttatgcctttcagcggggattttgttcagggatttataagctatgtagggtctcattatagagaagtgaaccttgtctaccctaggtacagcaacttcatatctactgaatcttatttagttatgacagatctcaaagctaaccggctaatgaatcctgaaaagatcaagcagcagataattgaatcatctgtacggacttcacctggacttataggtcacatcctatccattaagcaactaagctgcatacaagcaattgtgggaggcgcggttagtagaggtgatatcaaccctattctgaaaaaacttacacctatagagcaggtgctgatcagttgcgggttggcaattaacggacctaaactgtgcaaagaattaatccaccatgatgttgcctcagggcaagatggattgcttaactctatactcatcctctacagggagttggcaagattcaaagacaaccaaagaagtcaacaagggatgttccacgcttaccccgtattggtaagtagtaggcaacgagaacttgtatctaggatcactcgcaaattttgggggcatattcttctttactccgggaacagaaagttgataaatcggtttatccagaatctcaagtccggttatctagtactagacttacaccagaatatcttcgttaagaatctatccaagtcagagaaacagattattatgacggggggtttaaaacgtgagtgggtttttaaggtaacagtcaaggagaccaaagaatggtacaagttagtcggatacagcgctctgattaaggattaattggttgaactccggaaccctaatcctgccctaggtagttaggcattatttgcaatatattaaagaaaactttgaaaatacgaagtttctattcccagctttgtctggtggccggcatggtcccagcctcctcgctggcgccggctgggcaacattccgaggggaccgtcccctcggtaatggcgaatgggacgcggccgccgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgccagtgaattgtaatacgactcactata

SEQ ID NO: 16 - DNA, 21776 bp, Artificial Sequence
  p(+)MV323-CRYPHR-CIB1N
accaaacaaagttgggtaaggatagatcaatcaatgatcatattctagtacacttaggattcaagatcctattatcagggacaagagcaggattagggatatccgagggcgcgccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaagacgtcgagaggccgaggaccagaacaacatccgcctaccctccatcattgttataaaaaacttaggaaccaggtccacacagccgccagccaaccaaccatccactcccacgactggagttcgaacgagatggccacacttttgaggagcttagcattgttcaaaagaaacaaggacaaaccacccattacatcaggatccggtggagccatcagaggaatcaaacacattattatagtaccaattcctggagattcctcaattaccactcgatccagactactggaccggttggtcaggttaattggaaacccggatgtgagcgggcccaaactaacaggggcactaataggtatattatccttatttgtggagtctccaggtcaattgattcagaggatcaccgatgaccctgacgttagcatcaggctgttagaggttgttcagagtgaccagtcacaatctggccttaccttcgcatcaagaggtaccaacatggaggatgaggcggaccaatacttttcacatgatgatccaagcagtagtgatcaatccaggtccggatggttcgagaacaaggaaatctcagatattgaagtgcaagaccctgagggattcaacatgattctgggtaccattctagcccagatctgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctctttacgccgattcatggtggctctaatcctggatatcaagaggacacccgggaacaaacctaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaatctttaccagcaaatgggagaaactgcaccctacatggtaatcctagagaactcaattcagaacaagttcagtgcaggatcataccctctgctctggagctatgccatgggagtaggagtggaacttgaaaactccatgggaggtttgaactttggtcgatcttactttgatccagcatattttagattagggcaagagatggtgaggaggtcagctggaaaggtcagttccacattggcatccgaactcggtatcactgccgaggatgcaaggcttgtttcagagattgcaatgcatactactgaggacaggatcagtagagcggtcggacccagacaagcccaagtgtcatttctacacggtgatcaaagtgagaatgagctaccaggattggggggcaaggaagataggagggtcaaacagggtcggggagaagccagggagagctacagagaaaccgggtccagcagagcaagtgatgcgagagctgcccatcctccaaccagcatgcccctagacattgacactgcatcggagtcaggccaagatccgcaggacagtcgaaggtcagctgacgccctgctcaggctgcaagccatggcaggaatcttggaagaacaaggctcagacacggacacccctagggtatacaatgacagagatcttctagactaggtgcgagaggccgaggaccagaacaacatccgcctaccctccatcattgttataaaaaacttaggaaccaggtccacacagccgccagccaaccaaccatccactcccacgactggagccgatggcagaagagcaggcacgccatgtcaaaaacggactggaatgcatccgggctctcaaggccgagcccatcggctcactggccgtcgaggaagccatggcagcatggtcagaaatatcagacaacccaggacaggaccgagccacctgcaaggaagaggaggcaggcagttcgggtctcagcaaaccatgcctctcagcaattggatcaactgaaggcggtgcacctcgcatccgcggtcagggatctggagaaagcgatgacgacgctgaaactttgggaatcccctcaagaaatctccaggcatcaagcactgggttacagtgttatcatgtttatgatcacagcggtgaagcggttaagggaatccaagatgctgactctatcatggttcaatcaggccttgatggtgatagcaccctctcaggaggagacgatgaatctgaaaacagcgatgtggatattggcgaacctgataccgagggatatgctatcactgaccggggatctgctcccatctctatggggttcagggcttctgatgttgaaactgcagaaggaggggagatccacgagctcctgaaactccaatccagaggcaacaactttccgaagcttgggaaaactctcaatgttcctccgcccccgaaccccagtagggccagcacttccgagacacccattaaaaagggcacagacgcgagattggcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctccgatgtccaagacatcaaaacagccttggccaaaatacacgaggataatcagaagataatctccaagctagaatcattgctgttattgaagggagaagttgagtcaattaagaagcagatcaacaggcaaaatatcagcatatccaccctggaaggacacctctcaagcatcatgattgccattcctggacttgggaaggatcccaacgaccccactgcagatgtcgaactcaatcccgacctgaaacccatcataggcagagattcaggccgagcactggccgaagttctcaagaagcccgttgccagccgacaactccagggaatgactaatggacggaccagttccagaggacagctgctgaaggaatttcaactaaagccgatcgggaaaaaggtgagctcagccgtcgggtttgttcctgacaccggccctgcatcacgcagtgtaatccgctccattataaaatccagccggctagaggaggatcggaagcgttacctgatgactctccttgatgatatcaaaggagccaacgatcttgccaagttccaccagatgctgatgaagataataatgaagtagctacagctcaacttacctgccaaccccatgccagtcgacctaattagtacaacctaaatccattataaaaaacttaggagcaaagtgattgcctcctaagttccacaatgacagagatctacgatttcgacaagtcggcatgggacatcaaagggtcgatcgctccgatacaacctaccacctacagtgatggcaggctggtgccccaggtcagagtcatagatcctggtctaggtgataggaaggatgaatgctttatgtacatgtttctgctgggggttgttgaggacagcgatcccctagggcctccaatcgggcgagcattcgggtccctgcccttaggtgttggtagatccacagcaaaacccgaggaactcctcaaagaggccactgagcttgacatagttgttagacgtacagcagggctcaatgaaaaactggtgttctacaacaacaccccactaaccctcctcacaccttggagaaaggtcctaacaacagggagtgtcttcaatgcaaaccaagtgtgcaatgcggttaatctaataccgctggacaccccgcagaggttccgtgttgtttatatgagcatcacccgtctttcggataacgggtattacaccgttcccagaagaatgctggaattcagatcggtcaatgcagtggccttcaacctgctagtgacccttaggattgacaaggcgattggccctgggaagatcatcgacaatgcagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccactgatggatatcaatgaagaccttaatcggttactctggaggagcagatgcaagatagtaagaatccaggcagttttgcagccatcagttcctcaagaattccgcatttacgacgacgtgatcataaatgatgaccaaggactattcaaagttctgtagaccgcagtgcccagcaatacccgaaaacgacccccctcataatgacagccagaaggcccggacaaaaaagccccctccagaagactccacggaccaagcgagaggccagccagcagccgacagcaagtgtggacaccaggcggcccaagcacagaacagccccgacacaaggccaccaccagccatcccaatctgcgtcctcctcgtgggacccccgaggaccaaccccgaaggtcgctccgaacacagaccaccaaccgcatccccacagctcccgggaaaggaacccccagcaactggaaggcccctccccccctcccccaacgcaagaaccccacaaccgaaccgcacaagcgaccgaggtgacccaaccgcaggcatccgactccttagacagatcctctccccccggcatactaaacaaaacttagggccaaggaacacacacactcgacagaacccagaccccggcccgcggcaccgcgcccccaccccccgaaaaccagagggagcccccaaccaaacccgccggcccccccggtgcccacaggtaggcacaccaacccccgaccagacccagcacccagccaccgacaatccaagacggggggccccccccaaaaaaaggcccccaggggccgacagccagcatcgcgaggaagcacacccaccccacacacgaccacggcaaccgaaccagagtccagaccaccctgggccaccagctcccagactcggccatcaccccgcaaaaaggaaaggccacaacccgcgcaccccagccccgatccggcgggcagccactcaacccgaaccagcacccaagagcgatccctgggggacccccaaaccgcaaaagacatcagtatcccacagcctctccaagtcccccggtctcctcctcttctcgaagggaccaaaagatcaatccaccacatccgacgacactcaattccccacccccaaaggagacaccgggaatcccagaatcaagactcatccagtgtccatcatgggtctcaaggtgaacgtctctgccatattcatggcagtactgttaactctccaaacacccaccggtcaaatccattggggcaatctctctaagataggggtggtagggataggaagtgcaagctacaaagttatgactcgttccagccatcaatcattggtcataaaattaatgcccaatataactctcctcaataactgcacgagggtagagatcgcagaatacaggagactactgagaacagttttggaaccaattagagatgcacttaatgcaatgacccagaatataagaccggttcagagtgtagcttcaagtaggagacacaagagatttgcgggagttgtcctggcaggtgcggccctaggcgttgccacagctgctcagataacagccggcattgcacttcaccagtccatgctgaactctcaagccatcgacaatctgagagcaagcctggaaactactaatcaggcaattgaggcaatcagacaagcagggcaggagatgatattggctgttcagggtgtccaagactacatcaataatgagctgataccgtctatgaaccaactatcttgtgatttaatcggccagaagctagggctcaaattgctcagatactatacagaaatcctgtcattatttggccccagcttacgggaccccatatctgcggagatatccatccaggctttgagctatgcgcttggaggagatatcaataaggtattagaaaagctcggatacagtggaggtgatttactgggcatcttagagagcagaggaataaaggcccggataactcacgtcgacacagagtcctacttcattgtactcagtatagcctatccgacgctgtccgagattaagggggtgattgtccaccggctagagggggtctcgtacaatataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtccaccaagtcctgtgctcgtacactcgtatccgggtcttttgggaaccggttcattttatcacaagggaacctaatagccaattgtgcatcaatcctctgcaagtgttacacaacaggaacgatcattaatcaagaccctgacaagatcctaacatacattgctgccgatcactgcccggtggtcgaggtgaacggtgtgaccatccaagtcgggagcaggaggtatccggacgcggtgtacctgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtttacatcctgattgcagtgtgtcttggagggttgatagggatccccgctttaatatgttgctgcagggggcgctgtaacaaaaagggagaacaagttggtatgtcaagaccaggcctaaagcctgatcttacagggacatcaaaatcctatgtaaggtcgctctgatcctctacaactcttgaaacacagatttcccacaagtctcctcttcgtcatcaagcaaccaccgcatccagcatcaagcccacctgaaattgtctccggcttccctctggccgaacgatatcggtagttaattaaaacttagggtgcaagatcatccacaatgtcaccacaacgagaccgaataaatgccttctacaaagacaacccacatcctaagggaagtaggatagttattaacagagaacatcttatgattgatagaccttatgttttgctggctgttctattcgtcatgtttctgagcttgatcgggttgctagccattgcaggcattagactccatcgtgcagccatctacaccgcagagatccataagagcctcagcaccaatctagatgtaactaactcgatcgagcatcaggtcaaggacgtgctgacaccactcttcaagatcattggtgatgaagtgggcctgaggacacctcagagattcactgacctagtgaaattcatctctgacaaaattaaattccttaatccggatagggagtacgacttcagagatctcacttggtgtatcaacccgccagagagaatcaaattggattatgatcaatactgtgcagatgtggctgctgaagaactcatgaatgcattggtgaactcaactctactggaggccagggcaaccaatcagttcctagctgtctcaaagggaaactgctcagggcccactacaatcagaggtcaattctcaaacatgtcgctgtccctgttggacttgtatttaagtcgaggttacaatgtgtcatctatagtcactatgacatcccagggaatgtacgggggaacttacctagtgggaaagcctaatctgagcagtaaagggtcagagttgtcacaactgagcatgcaccgagtgtttgaagtaggggttatcagaaatccgggtttgggggctccggtgttccatatgacaaactattttgagcaaccagtcagtaatgatttcagcaactgcatggtggctttgggggagcttaaattcgcagccctctgtcacagggaagattctatcacaattccctatcaggggtcagggaaaggtgtcagcttccagctcgtcaagctaggtgtctggaaatccccaaccgacatgcgatcctgggtccccctatcaacggatgatccagtgatagataggctttatctctcatctcacagaggtgttatcgctgacaatcaagcaaaatgggctgtcccgacaacacggacagatgacaagttgcgaatggagacatgcttccagcaggcgtgtaagggtaaaaaccaagcactctgcgagaatcccgagtgggcaccattgaaggataacaggattccttcatacggggtcttgtctgttaatctgagtctgacagttgagcttaaaatcaaaattgcttcaggattcgggccattgatcacacacggttcagggatggacctatacaaaaccaaccacaacaatgtgtattggctgactatcccgccaatgaagaacctagccttaggtgtaatcaacacattggagtggataccgagattcaaggttagtcccaacctcttcactgttccaatcaaggaagcaggcgaggactgccatgccccaacatacctacctgcggaggtggatggtgatgtcaaactcagttccaatctggtaattctacctggtcaggatctccaatatgttttggcaacctacgatacttccagggttgaacatgctgtggtttattatgtttacagcccaagccgctcattttcttacttttatccttttaggttgcctataaagggggtcccaatcgaattacaagtggaatgcttcacatgggacaaaaaactctggtgccgtcacttctgtgtgcttgcggactcagaatctggtggacatatcactcactctgggatggtgggcatgggagtcagctgcacagtcactcgggaagatggaaccaatcgcagatagggctgccagtgaaccgatcacatgatgtcacccagacatcaggcatacccactagtgtgaaatagacatcagaattaagaaaaacgtagggtccaagtggtttcccgttatggactcgctatctgtcaaccagatcttataccctgaagttcacctagatagcccgatagttaccaataagatagtagctatcctggagtatgctcgagtccctcacgcttacagcctggaggaccctacactgtgtcagaacatcaagcaccgcctaaaaaacggattctccaaccaaatgattataaacaatgtggaagttgggaatgtcatcaagtccaagcttaggagttatccggcccactctcatattccatatccaaattgtaatcaggatttatttaacatagaagacaaagagtcaacaaggaagatccgtgagctcctaaaaaagggaaattcgctgtactccaaagtcagtgataaggttttccaatgcctgagggacactaactcacggcttggcctaggctccgaattgagggaggacatcaaggagaaaattattaacttgggagtttacatgcacagctcccaatggtttgagccctttctgttttggtttacagtcaagactgagatgaggtcagtgattaaatcacaaacccatacttgccataggaggagacacacacctgtattcttcactggtagttcagttgagctgttaatctctcgtgaccttgttgctataatcagtaaggaatctcaacatgtatattacctgacgtttgaactggttttgatgtattgtgatgtcatagaggggaggttaatgacagagaccgctatgaccattgatgctaggtatgcagaacttctaggaagagtcagatacatgtggaaactgatagatggtttcttccctgcactcgggaatccaacttatcaaattgtagccatgctggagccactttcacttgcttacctgcaactgagggatataacagtagaactcagaggtgctttccttaaccactgctttactgaaatacatgatgttcttgaccaaaacgggttttctgatgaaggtacttatcatgagttaattgaagccctagattacattttcataactgatgacatacatctgacaggggagattttctcatttttcagaagtttcggccaccccagacttgaagcagtaacggctgctgaaaatgtcaggaaatacatgaatcagcctaaagtcattgtgtatgagactctgatgaaaggtcatgccatattttgtggaatcataatcaacggctatcgtgacaggcacggaggcagttggccacccctgaccctccccctgcatgctgcagacacaatccggaatgctcaagcttcaggtgaagggttaacacatgagcagtgcgttgataactggaaatcatttgctggagtgagatttggctgttttatgcctcttagcctggacagtgatctgacaatgtacctaaaggacaaggcacttgctgctctccaaagggaatgggattcagtttacccgaaagagttcctgcgttacgatcctcccaagggaaccgggtcacggaggcttgtagatgttttccttaatgattcgagctttgacccatatgatatgataatgtatgtcgtaagtggagcctacctccatgaccctgagttcaacctgtcttacagcctgaaagaaaaggagatcaaggaaacaggtagacttttcgctaaaatgacttacaaaatgagggcatgccaagtgatcgctgaaaatctaatctcaaacgggattggcaagtattttaaggacaatgggatggccaaggatgagcacgatttgactaaggcactccacactctggctgtctcaggagtccccaaagatctcaaagaaagtcacaggggggggccagtcttaaaaacctactcccgaagcccagtccacacaagtaccaggaacgttaaagcagaaaaagggtttgtaggattccctcatgtaattcggcagaatcaagacactgatcatccggagaatatagaaacctacgagacagtcagcgcatttatcacgactgatctcaagaagtactgccttaattggagatatgagaccatcagcttatttgcacagaggctaaatgagatttacggattaccctcattttttcagtggctgcataagaggcttgaaacctctgtcctctatgtaagtgaccctcattgcccccccgaccttgacgcccatgtcccgttatgcaaagtccccaatgaccaaatcttcatcaagtaccctatgggaggtatagaagggtattgtcagaagctgtggaccatcagcaccattccctacttatacctggctgcttatgagagcggggtaaggattgcttcgttagtgcaaggggacaatcagaccatagccgtaacaaaaagggtacccagcacatggccttacaaccttaagaaacgggaagctgctagagtaactagagattactttgtaattcttaggcaaaggctacatgacattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcggcatgcagtaatattgctacaacaatggccaaaagcattgagagaggttatgaccgttatcttgcatattccctgaacgtcctaaaagtgatacagcaaattttgatctcccttggcttcacaatcaattcaaccatgacccgggatgtagtcatacccctcctcacaaacaacgatctcttaataaggatggcactgttgcccgctcctattgggggtatgaattatctgaatatgagcaggctgtttgtcagaaacatcggtgatccagtaacatcatcaattgctgatctcaagagaatgattctcgcatcactaatgcctgaagagaccctccatcaagtaatgacacaacaaccgggggactcttcattcctagactgggctagcgacccttactcagcaaatcttgtatgcgtccagagcatcactagactcctcaagaacataactgcaaggtttgtcctgatccacagtccaaacccaatgttaaaagggttattccatgatgacagcaaagaagaggacgagagactggcggcattcctcatggacaggcatattatagtacctagggcagctcatgaaatcctggatcatagtgtcacaggggcaagagagtctattgcaggcatgctagataccacaaaaggcctgattcgagccagcatgaggaagggggggttaacctctcgagtgataaccagattgtccaattatgactatgaacaatttagagcagggatggtgctattgacaggaagaaagagaaatgtcctcattgacaaagagtcatgttcagtgcagctggctagagccctaagaagccatatgtgggcaagactagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagctcgccttcgtaagagccccaagtagatccttgcgatctgccgttagaatagcaacagtgtactcatgggcttacggtgatgatgatagctcttggaacgaagcctggttgttggcaaggcaaagggccaatgtgagcctggaggagctaagggtgatcactcccatctcgacttcgactaatttagcgcataggttgagggatcgtagcactcaagtgaaatactcaggtacatcccttgtccgagtggcaaggtataccacaatctccaacgacaatctctcatttgtcatatcagataagaaggttgatactaactttatataccaacaaggaatgcttctagggttgggtgttttagaaacattgtttcgactcgagaaagatactggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattctagctaagtccacagcactatctatgattgacctggtaacaaaatttgagaaggaccatatgaatgaaatttcagctctcataggggatgacgatatcaatagtttcataactgagtttctgcttatagagccaagattattcaccatctacttgggccagtgtgcagccatcaattgggcatttgatgtacattatcatagaccatcagggaaatatcagatgggtgagctgttgtcttcgttcctttctagaatgagcaaaggagtgtttaaggtgcttgtcaatgctctaagccacccaaagatctacaagaaattctggcattgtggtattatagagcctatccatggtccttcacttgatgctcaaaacttgcacacaactgtgtgcaacatggtttacacatgctatatgacctacctcgacctgttgttgaatgaagagttagaagagttcacatttcttttgtgtgaaagcgatgaggatgtagtaccggacagattcgacaacatccaggcaaaacacttgtgtgttctggcagatttgtactgtcaaccagggacctgcccaccgattcgaggtctaaggccggtagagaaatgtgcagttctaaccgatcatatcaaggcagaggctaggttatctccagcaggatcttcgtggaacataaatccaattattgtagaccattactcatgctctctgacttatctccgtcgaggatctatcaaacagataagattgagagttgatccaggattcatttttgacgccctcgctgaggtaaatgtcagtcagccaaaggtcggcagcgacgtcaagatggacaaaaagactatagtttggtttagaagagacctaaggattgaggataatcctgcattagcagcagctgctcacgaaggatctgtttttcctgtcttcatttggtgtcctgaagaagaaggacagttttatcctggaagagcttcaagatggtggatgaaacaatcacttgctcacttatctcaatccttgaaggctcttggatctgacctcactttaatcaaaacccacaacacgatttcagcgatcttggattgtatccgcgttaccggtgctacaaaagtcgtctttaaccacctctatgatcctgtttcgttagttcgggaccataccgtaaaggagaagctggtggaacgtgggatctctgtgcaaagctacaatggagatctattgtatgaaccgtgggagatatactgcgaaaagggcaaaccttttacgagtttcaattcttactggaagaaatgcttagatatgtcgattgaatccgttatgcttcctcctccttggcggttgatgccaataactgcagcggctgaagcgatttgggcgtgttcgattgaagaactagggctggagaatgaggccgagaaaccgagcaatgcgttgttaactagagcttggtctccaggatggagcaatgctgataagttactaaatgagttcatcgagaagcagttgatagattatgcaaagaacagcaagaaagttgttgggaattctacttcactactttctccgtatctccatttcggggaaataagcgtcagacacgttttccagtgtgcccggatgaaacaaattatatgggcaagagataagaacagtgaaggagaagaaagtgcagatctttttcttaggggaatcggtttaagagagtattctcggtatatatgtttcaacttcccgtttactcacgagcaatcgttgttgagtcatcttcggtttttcccttgggatgctgatgttgataagttcaaggcctggagacaaggcaggaccggttatccgttggtggatgccggaatgagagagctttgggctaccggatggatgcataacagaataagagtgattgtttcaagctttgctgtgaagtttcttctccttccatggaaatggggaatgaagtatttctgggatacacttttggatgctgatttggaatgtgacatccttggctggcagtatatctctgggagtatccccgatggccacgagcttgatcgcttggacaatcccgcgttacaaggcgccaaatatgacccagaaggtgagtacataaggcaatggcttcccgagcttgcgagattgccaactgaatggatccatcatccatgggacgctcctttaaccgtactcaaagcttctggtgtggaactcggaacaaactatgcgaaacccattgtagacatcgacacagctcgtgagctactagctaaagctatttcaagaacccgtgaagcacagatcatgatcggagcagcaaccggtaattccgctgacggcggcggaggatcgggtggtagtggtggttcaggaggaggatcgacccaaggaggatccatgaatggagctataggaggtgaccttttgctcaattttcctgacatgtcggtcctagagcgccaaagggctcacctcaagtacctcaatcccacctttgattctcctctcgccggcttctttgccgattcttcaatgattaccggcggcgagatggacagctatctttcgactgccggtttgaatcttccgatgatgtacggtgagacgacggtggaaggtgattcaagactctcaatttcgccggaaacgacgcttgggactggaaatttcaaggcagcgaagtttgatacagagactaaggattgtaatgaggcggcgaagaagatgacgatgaacagagatgacctagtagaagaaggagaagaagagaagtcgaaaataacagagcaaaacaatgggagcacaaaaagcatcaagaagatgaaacacaaagccaagaaagaagagaacaatttctctaatgattcatctaaagtgacgaaggaattggagaaaacggattatattggctatccgtacgacgtcccagattacgcgggcatctcaaatatgagcatcaaggatttcagacctccacacgatgatgttgcaaaattgctcaaagatatcaacacaagcaagcacaatcttcccatttcagggggtagtctcgccaattatgaaatccatgctttccgcagaatcgggttaaactcatctgcttgctacaaagctgttgagatatcaacattaattaggagatgccttgagccaggggaagacggcttgttcttgggtgaggggtcgggttctatgttgatcacttataaggagatactaaaactaaacaagtgcttctataatagtggggtttccgccaattctagatctggtcaaagggaattagcaccctatccctccgaagttggccttgtcgaacacagaatgggagtaggtaatattgtcaaggtgctctttaacgggaggcccgaagtcacgtgggtaggcagtatagattgcttcaatttcatagtcagtaatatccctacctctagtgtggggtttatccattcagatatagagaccttacctaacaaagatactatagagaagctagaggaattggcagccatcttatcgatggctctactccttggcaaaataggatcaatactggtgattaagcttatgcctttcagcggggattttgttcagggatttataagctatgtagggtctcattatagagaagtgaaccttgtctaccctaggtacagcaacttcatatctactgaatcttatttagttatgacagatctcaaagctaaccggctaatgaatcctgaaaagatcaagcagcagataattgaatcatctgtacggacttcacctggacttataggtcacatcctatccattaagcaactaagctgcatacaagcaattgtgggaggcgcggttagtagaggtgatatcaaccctattctgaaaaaacttacacctatagagcaggtgctgatcagttgcgggttggcaattaacggacctaaactgtgcaaagaattaatccaccatgatgttgcctcagggcaagatggattgcttaactctatactcatcctctacagggagttggcaagattcaaagacaaccaaagaagtcaacaagggatgttccacgcttaccccgtattggtaagtagtaggcaacgagaacttgtatctaggatcactcgcaaattttgggggcatattcttctttactccgggaacagaaagttgataaatcggtttatccagaatctcaagtccggttatctagtactagacttacaccagaatatcttcgttaagaatctatccaagtcagagaaacagattattatgacggggggtttaaaacgtgagtgggtttttaaggtaacagtcaaggagaccaaagaatggtacaagttagtcggatacagcgctctgattaaggattaattggttgaactccggaaccctaatcctgccctaggtagttaggcattatttgcaatatattaaagaaaactttgaaaatacgaagtttctattcccagctttgtctggtggccggcatggtcccagcctcctcgctggcgccggctgggcaacattccgaggggaccgtcccctcggtaatggcgaatgggacgcggccgccgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgccagtgaattgtaatacgactcactata

SEQ ID NO: 17 - DNA, 29 bp, Artificial Sequence
  EGFP Forward Primer
ggcgcgccatggtgagcaagggcgaggag

SEQ ID NO: 18 - DNA, 30 bp, Artificial Sequence
  EGFP Reverse Primer
gacgtcttacttgtacagctcgtccatgcc

SEQ ID NO: 19 - DNA, 35 bp, Artificial Sequence
  DP Forward1 Primer
ggtcggcagcgacgtcatggtgagcgtgatcaagc

SEQ ID NO: 20 - DNA, 22 bp, Artificial Sequence
  DP Forward2 Primer
atggtgagcgtgatcaagcccg

SEQ ID NO: 21 - DNA, 40 bp, Artificial Sequence
  DP Reverse1 Primer
gatcacgctcaccatggatcctccttgggtcgatcctcct

SEQ ID NO: 22 - DNA, 37 bp, Artificial Sequence
  DP Reverse2 Primer
ctcatatttgagatgacgtccttggcctggcggggca

SEQ ID NO: 23 - DNA, 44 bp, Artificial Sequence
  pMagnMaghigh Forward1 Primer
caaaggtcggcagcgacgtcagccatactctttatgcccccggt

SEQ ID NO: 24 - DNA, 61 bp, Artificial Sequence
  pMagnMaghigh Forward2 Primer
gggtggtagtggtggttcaggaggaggatcgacccaaggaggatccatgcatactctttat

SEQ ID NO: 25 - DNA, 61 bp, Artificial Sequence
  pMagnMaghigh Reverse2 Primer
ccaccactaccacccgatcctccgccgccgtcagcggaattaccggtttctgtttcgcact

SEQ ID NO: 26 - DNA, 49 bp, Artificial Sequence
  pMagnMaghigh Reverse2 Primer
cccgcgtaatctgggacgtcgtacggatattctgtttcgcactggaatc

SEQ ID NO: 27 - DNA, 31 bp, Artificial Sequence
  Reverse3 Primer
ctcatatttgagatgcccgcgtaatctggga

SEQ ID NO: 28 - DNA, 48 bp, Artificial Sequence
  CRY2-CIB1N Forward1 Primer
caaaggtcggcagcgacgtcaagatggacaaaaagactatagtttggt

SEQ ID NO: 29 - DNA, 61 bp, Artificial Sequence
  CRY2-CIB1N Forward2 Primer
gggtggtagtggtggttcaggaggaggatcgacccaaggaggatccatgaatggagctata

SEQ ID NO: 30 - DNA, 64 bp, Artificial Sequence
  CRY2-CIB1N Reverse1 Primer
ccaccactaccacccgatcctccgccgccgtcagcggaattaccggttttgcaaccattttttc

SEQ ID NO: 31 - DNA, 54 bp, Artificial Sequence
  CRY2-CIB1N Reverse2 Primer
cccgcgtaatctgggacgtcgtacggatagccaatataatccgttttctccaat

SEQ ID NO: 32 - DNA, 62 bp, Artificial Sequence
  CRYPHR-CIB1N Reverse1 Primer
ccaccactaccacccgatcctccgccgccgtcagcggaattaccggttgctgctccgatcat

SEQ ID NO: 33 - DNA, 5313 bp, Artificial Sequence
  pCITE-IC-N
gggcgaattaattccggttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataataccatggccacacttttgaggagcttagcattgttcaaaagaaacaaggacaaaccacccattacatcaggatccggtggagccatcagaggaatcaaacacattattatagtaccaattcctggagattcctcaattaccactcgatccagactactggaccggttggtcaggttaattggaaacccggatgtgagcgggcccaaactaacaggggcactaataggtatattatccttatttgtggagtctccaggtcaattgattcagaggatcaccgatgaccctgacgttagcatcaggctgttagaggttgttcagagtgaccagtcacaatctggccttaccttcgcatcaagaggtaccaacatggaggatgaggcggaccaatacttttcacatgatgatccaagcagtagtgatcaatccaggtccggatggttcgagaacaaggaaatctcagatattgaagtgcaagaccctgagggattcaacatgattctgggtaccattctagcccagatctgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctctttacgccgattcatggtggctctaatcctggatatcaagaggacacccgggaacaaacctaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaatctttaccagcaaatgggagaaactgcaccctacatggtaatcctagagaactcaattcagaacaagttcagtgcaggatcataccctctgctctggagctatgccatgggagtaggagtggaacttgaaaactccatgggaggtttgaactttggtcgatcttactttgatccagcatattttagattagggcaagagatggtgaggaggtcagctggaaaggtcagttccacattggcatccgaactcggtatcactgccgaggatgcaaggcttgtttcagagattgcaatgcatactactgaggacaggatcagtagagcggtcggacccagacaagcccaagtgtcatttctacacggtgatcaaagtgagaatgagctaccaggattggggggcaaggaagataggagggtcaaacagggtcggggagaagccagggagagctacagagaaaccgggtccagcagagcaagtgatgcgagagctgcccatcctccaaccagcatgcccctagacattgacactgcatcggagtcaggccaagatccgcaggacagtcgaaggtcagctgacgccctgctcaggctgcaagccatggcaggaatcttggaagaacaaggctcagacacggacacccctagggtatacaatgacagagatcttctagactagctcgagcaccaccaccaccccactgagatctccgatcctctagagtcgatcgacctgcaggcatgcaagcttttgttccctttagtgagggttaattccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactata

SEQ ID NO: 34 - DNA, 5259 bp, Artificial Sequence
  pCITE-IC-PdeltaC
gggcgaattaattccggttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataataccatggcagaagagcaggcacgccatgtgaaaaacggactagaatgcatccgggctctcaaggccgagcccatcggctcactggccgtcgaggaagccatggcagcatggtcagaaatatcagacaacccaggacaggaccgagccacctgcaaggaagaggaggcaggcagttcgggtctcagcaaaccatgcctctcagcaattggatcaactgaaggcggtgcacctcgcatccgcggtcagggatctggagaaagcgatgacgacgctgaaactttgggaatcccctcaagaaatctccaggcatcaagcactgggttacagtgttatcatgtttatgatcacagcggtgaagcggttaagggaatccaagatgctgactctatcatggttcaatcaggccttgatggtgatagcaccctctcaggaggagacgatgaatctgaaaacagcgatgtggatattggcgaacctgataccgagggatatgctatcactgaccggggatctgctcccatctctatggggttcagggcttctgatgttgaaactgcagaaggaggggagatccacgagctcctgaaactccaatccagaggcaacaactttccgaagcttgggaaaactctcaatgttcctccgcccccgaaccccagtagggccagcacttccgagacacccattaaaaagggcacagacgcgagattggcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctccgatgtccaagacatcaaaacagccttggccaaaatacacgaggataatcagaagataatctccaagctagaatcattgctgttattgaagggagaagttgagtcaattaagaagcagatcaacaggcaaaatatcagcatatccaccctggaaggacacctctcaagcatcatgattgccattcctggacttgggaaggatcccaacgaccccactgcagatgtcgaactcaatcccgacctgaaacccatcataggcagagattcaggccgagcactggccgaagttctcaagaagcccgttgccagccgacaactccagggaatgactaatggacggaccagttccagaggacagctgctgaaggaatttcaactaaagccgatcgggaaaaaggtgagctcagccgtcgggtttgttcctgacaccggccctgcatcacgcagtgtaatccgctccattataaaatccagccggctagaggaggatcggaagcgttacctgatgactctccttgatgatatcaaaggagccaacgatcttgccaagttccaccagatgctgatgaagataataatgaagtagctcgagcaccaccaccaccccactgagatctccgatcctctagagtcgatcgacctgcaggcatgcaagcttttgttccctttagtgagggttaattccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactata

SEQ ID NO: 35 - DNA, 10330 bp, Artificial Sequence
  pCITE-9301B-wtL
gggcgaattaattccggttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataataccatggaattcatggactcgctatctgtcaaccagatcctataccctgaagttcacctagatagcccgatagttaccaataagatagtagctatcctggagtatgctcgagtccctcacgcttacagcctggaggaccctacactgtgtcagaacatcaagcaccgcctaaaaaacggattctccaaccaaatgattataaacaatgtggaagttgggaatgtcatcaagtccaagcttaggagttatccggcccactctcatattccatatccaaattgtaatcaggatttatttaacatagaagacaaagagtcaacaaggaagatccgtgagctcctaaaaaagggaaattcgctgtactccaaggtcagtgataaggttttccaatgcctgagggacactaattcacggcttggcttaggctctgaattgagagaggacatcaaggagaaaattattaacttgggagtttacatgcacagctcccaatggtttgagccctttctgttttggtttacagtcaagactgagatgaggtcagtgatcaaatcacaaacccatacttgccataggaggagacacacacctgtattcttcactggtagttcagttgagctgttaatctctcgtgaccttgttgctataattagtaaagagtctcaacatgtatattacctgacgtttgaactggttttgatgtattgtgatgtcatagaggggaggttaatgacagagaccgctatgaccattgatgctaggtatgcagaacttctaggaagagtcagatacatgtggaaactgatagatggtttcttccctgcactcgggaacccaacttatcaaattgtagccatgctggagccactttcacttgcttacctgcaactgagggatataacagtagaactcagaggtgctttccttaaccactgctttactgaaatacatgatgttcttgaccaaaacgggttttctgatgaaggtacttatcatgagttaattgaagccctagattacattttcataactgatgacatacatttgacaggggagattttctcatttttcagaagtttcggccaccccagacttgaagcagtaacggctgctgaaaatgttaggaaatacatgaatcagcctaaagtcattgtgtatgagactctgatgaaaggtcatgccatattttgtggaatcataatcaacggctatcgtgacaggcacggaggcagttggccacccctgaccctccccctgcatgctgcagacacaatccggaatgcccaagcctcaggcgaagggttaacacatgagcagtgcgttgataactggaaatcatttgctggagtgagatttggctgttttatgcctcttagcctggacagtgatctgacaatgtacctaaaggacaaggcacttgctgctctccaaagggaatgggattcagtttacccgaaagagtttctgcgttacgatcctcccaagggaaccgggtcacggaggcttgtagatgttttccttaatgattcgagctttgacccatatgatatgataatgtatgtcgtaagtggagcttacctccatgactctgagttcaacctgtcttacagcctgaaagaaaaggagatcaaggaaacaggtagactttttgctaaaatgacttacaaaatgagggcatgccaagtgattgctgaaaatctaatctcaaacgggattggcaaatattttaaggacaatgggatggccaaggatgagcacgatttgaccaaggcactccacactctagctgtctcaggagtccccaaagatctcaaagaaagtcacaggggggggccagtcttaaaaacctactcccgaagcccagtccacacaagtaccaggaacgttaaagcagcaaaagggtttgtaggattccctcatgtaattcgggagaatcaagacactgatcatccggagaatatagaaacttacgagacagtcagcgcatttatcacgactgatctcaagaagtactgccttaattggagatatgagaccatcagcttatttgcacagaggctaaatgagatttacggattaccctcattttttcagtggctgcataagaggcttgaaacctctgtcctctatgtaagtgaccctcattgcccccccgaccttgacgcccatgtcccgttatgcaaagtccctaatgaccaaatcttcatcaagtaccctatgggaggcatagaagggtattgtcagaagttgtggaccatcagcaccattccctacttatacctggctgcttatgagagcggagtaaggattgcttcgttagtgcaaggggacaatcagaccatagccgtaacaaaaagggtacccagcacatggccttacaaccttaagaaacgggaagctgctagagtaactagagattactttgtaattcttaggcaaaggctacatgacattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcggcatgcagtaatattgctacaacaatggccaaaagcattgagagaggttatgaccgttatcttgcatattccctgaacgtcctaaaagtgatacagcaaattttgatctcccttggcttcacaatcaattcaaccatgacccgggatgtagtcatacccctcctcacaaacaacgatctcttaataaggatggcactgttgcccgctcctattgggggtatgaattatctgaatatgagcaggctgtttgtcagaaacatcggtgatccagtaacatcatcaattgctgatctcaagagaatgattctcgcatcactaatgcctgaagagaccctccatcaagtaatgacacaacaaccgggggactcttcattcctagactgggctagcgacccttactcagcaaatcttgtatgcgtccagagcatcactagactcctcaagaacataactgcaaggtttgtcctgatccacagtccaaacccaatgttaaaagggttattccatgatgacagcaaagaagaggacgagagactggcggcattcctcatggacaggcatattatagtacctagggcagctcatgaaatcctggatcatagtgtcacaggggcaagagagtctattgcaggcatgctagataccacaaaaggcctgattcgagccagcatgaggaaaggggggttaacctctcgagtgataaccagattgtccaattatgactatgaacaatttagagcagggatggtgctattgacaggaagaaagagaaatgtcctcattgacaaagagtcatgttcagttcaactggctagagccctaagaagccatatgtgggcaagactagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagctcgccttcgtaagagccccaagtcgatccttgcgatctgctgttagaatagcaacagtgtactcatgggcttacggtgatgatgatagttcttggaacgaagcctggttgttggcaaggcaaagggccaatgtgagcctggaggagctaagggtgatcactcccatctcaacttcgactaatttagcgcataggttgagggatcgtagcactcaagtgaaatactcaggtacatcccttgtccgagtggcaaggtataccacaatctccaacgacaatctctcatttgtcatatcagataagaaggttgatactaactttatataccaacaaggaatgcttctagggttgggtgttttagaaacattgtttcgactcgagaaagatactggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattctagctaagtccacagcactatctatgattgacctggtaacaaaatttgagaaggaccatatgaatgaaatttcagctctcataggggatgacgatatcaatagtttcataactgagtttctgcttatagagccaagattattcactatctacttgggccagtgtgcagccatcaattgggcatttgatatacattatcatagaccatcagggaaatatcagatgggtgagctgttgtcttcgttcctttctagaatgagcaaaggagtgtttaaggtgcttgtcaatgctctaagccacccaaagatctacaagaaattctggcactgtggtattatagagcctatccatggtccttcacttgatgctcaaaacttgcacacaactgtgtgcaacatggtttacacatgctatatgacctacctcgacctgttgttgaatgaagagttagaagagttcacatttcttttgtgtgaaagcgacgaggatgtagtaccggacagattcgacaacatccaggcaaaacacttgtgtgttctagcagatttgtactgtcaaccagggacctgcccaccgattcgaggtctaagaccggtagagaaatgtgcagttctaaccgatcatatcaaggcagaggctaggttatctccagcagggtcttcgtggaacataaatccaattattgtagaccattactcatgctctctgacttatctccggcggggatctatcaaacagataagattgagagttgatccgggattcatttttgacgccctcgctgaggtaaatgtcagtcaaccaaagatcggcagcaacaacatctcaaatatgagcatcaaggatttcagacctccacacgatgatgttgcaaaactgctcaaagatatcaacacaagcaagcacaatcttcccatttcagggggtagtctcgccaattatgaaatccatgctttccgcaggatcgggttaaactcatctgcttgctacaaagctgttgagatatcaacattaattaggagatgccttgagccaggggaagacggcttgttcttgggtgaggggtcgggttctatgttgatcacttataaggagatactaaaactaaacaagtgcttctataatagtggggtttccgccaattctagatctggtcaaagggaattagcaccctatccctccgaagttggccttgtcgaacacagaatgggagtaggtaatattgtcaaagtgctctttaacgggaggcccgaagtcacgtgggtaggcagtatagattgcttcaatttcatagtcagtaacatccctacctctagtgtggggtttatccattcagatatagagaccttacctaacaaagatactatagagaagctagaggaattggcagccatcttatcgatggctctgctccttggcaaaataggatcaatactggtgattaagcttatgcctttaagcggggattttgttcagggatttataagctatgtagggtctcattatagagaagtgaaccttgtttaccctaggtacagcaacttcatatctactgaatcttatttagttatgacagatctcaaagctaaccggctaataaatcctgaaaagattaagcagcagataatcgaatcatctgtgcggacttcacctggacttataggtcacatcctatccattaagcaactaagctgcatacaagcaattgtgggaggcgcagttagtagaggtgatatcaaccctactctgaaaaaacttacacctatagagcaggtgctgatcagttgcgggttgacaattaacggacctaaactgtgcaaagaattaatccaccatgatgttgcctcagggcaagatggattgcttaactctatactcatcctctacagggagttggcaagattcaaagacaaccaaagaagtcaacaagggatgttccacgcttaccccgtattggtaagtagcaggcaacgagaacttgtatctaggatcacccgcaaattttgggggcatattcttctttactccgggaacagaaagttgataaatcggtttatccagaatctcaaatccggttatctaatactagacttacaccagaatatcttcgttaagaatctatctaagtcagagaaacagattattatgacggggggtttaaaacgtgagtgggtttttaaggtaacagtcaaggagaccaaagaatggtataagttggtcggatacagtgccctgattaaggattaagaattccttaattaatgcggccgcagcgatcgcactcgagcaccaccaccaccccactgagatctccgatcctctagagtcgatcgacctgcaggcatgcaagcttttgttccctttagtgagggttaattccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactata

SEQ ID NO: 36 - protein, 2181 aa, Measles virus
MDSLSVNQILYPEVHLDSPIVTNKIVAILEYARVPHAYSLEDPTLCQNIKHRLKNGFSNQMIINNVEVGNVIKSKLRSYPAHSHIPYPNCNQDLFNIEDKESTRKIRELLKKGNSLYSKVSDKVFQCLRDTNSRLGLGSELREDIKEKIINLGVYMHSSQWFEPFLFWFTVKTEMRSVIKSQTHTCHRRRHTPVFFTGSSVELLISRDLVAIISKESQHVYYLTFELVLMYCDVIEGRLMTETAMTIDARYAELLGRVRYMWKLIDGFFPALGNPTYQIVAMLEPLSLAYLQLRDITVELRGAFLNHCFTEIHDVLDQNGFSDEGTYHELIEALDYIFITDDIHLTGEIFSFFRSFGHPRLEAVTAAENVRKYMNQPKVIVYETLMKGHAIFCGIIINGYRDRHGGSWPPLTLPLHAADTIRNAQASGEGLTHEQCVDNWKSFAGVRFGCFMPLSLDSDLTMYLKDKALAALQREWDSVYPKEFLRYDPPKGTGSRRLVDVFLNDSSFDPYDMIMYVVSGAYLHDPEFNLSYSLKEKEIKETGRLFAKMTYKMRACQVIAENLISNGIGKYFKDNGMAKDEHDLTKALHTLAVSGVPKDLKESHRGGPVLKTYSRSPVHTSTRNVKAEKGFVGFPHVIRQNQDTDHPENIETYETVSAFITTDLKKYCLNWRYETISLFAQRLNEIYGLPSFFQWLHKRLETSVLYVSDPHCPPDLDAHVPLCKVPNDQIFIKYPMGGIEGYCQKLWTISTIPYLYLAAYESRVRIASLVQGDNQTIAVTKRVPSTWHYNLKKREAARVTRDYFVILRQRLHDIGHHLKANETIVSSHFFVYSKGIYYDGLLVSQSLKSIARCVFWSETIVDETRAACSNIATTMAKSIERGYDRYLAYSLNVLKVIQQILISLGFTINSTMTRDVVIPLLTNNDLLIRMALLPAPIGGMNYLNMSRLFVRNIGDPVTSSIADLKRMILASLMPEETLHQVMTQQPGDSSFLDWASDPYSANLVCVQSITRLLKNITARFVLIHSPNPMLKGLFHDDSKEEDERLAAFLMDRHIIVPRAAHEILDHSVTGARESIAGMLDTTKGLIRASMRKGGLTSRVITRLSNYDYEQFRAGMVLLTGRKRNVLIDKESCSVQLARALRSHMWARLARGRPIYGLEVPDVLESMRGHLIRRHETCVICECGSVNYGWFFVPSGCQLDDIDKETSSLRVPYIGSTTDERTDMKLAFVRAPSRSLRSAVRIATVYSWAYGDDDSSWNEAWLLARQRANVSLEELRVITPISTSTNLAHRLRDRSTQVKYSGTSLVRVARYTTISNDNLSFVISDKKVDTNFIYQQGMLLGLGVLETLFRLEKDTGSSNTVLHLHVETDCCVIPMIDHPRIPSSRKLELRAELCTNPLIYDNAPLIDRDATRLYTQSHRRHLVEFVTWSTPQLYHILAKSTALSMIDLVTKFEKDHMNEISALIGDDDINSFITEFLLIEPRLFTIYLGQCAAINWAFDVHYHRPSGKYQMGELLSSFLSRMSKGVFKVLVNALSHPKIYKKFWHCGIIEPIHGPSLDAQNLHTTVCNMVYTCYMTYLDLLLNEELEEFTFLLCESDEDVVPDRFDNIQAKHLCVLADLYCQPGTCPPIRGLRPVEKCAVLTDHIKAEARLSPAGSSWNINPIIVDHYSCSLTYLRRGSIKQIRLRVDPGFIFDALAEVNVSQPKVGSISNMSIKDFRPPHDDVAKLLKDINTSKHNLPISGGSLANYEIHAFRRIGLNSSACYKAVEISTLIRRCLEPGEDGLFLGEGSGSMLITYKEILKLNKCFYNSGVSANSRSGQRELAPYPSEVGLVEHRMGVGNIVKVLFNGRPEVTWVGSIDCFNFIVSNIPTSSVGFIHSDIETLPNKDTIEKLEELAAILSMALLLGKIGSILVIKLMPFSGDFVQGFISYVGSHYREVNLVYPRYSNFISTESYLVMTDLKANRLMNPEKIKQQIIESSVRTSPGLIGHILSIKQLSCIQAIVGGAVSRGDINPILKKLTPIEQVLISCGLAINGPKLCKELIHHDVASGQDGLLNSILILYRELARFKDNQRSQQGMFHAYPVLVSSRQRELVSRITRKFWGHILLYSGNRKLINRFIQNLKSGYLVLDLHQNIFVKNLSKSEKQIIMTGGLKREWVFKVTVKETKEWYKLVGYSALIKD

SEQ ID NO: 37 - protein, 2425 aa, Artificial Sequence
  Ln-EGFP-Lc
MDSLSVNQILYPEVHLDSPIVTNKIVAILEYARVPHAYSLEDPTLCQNIKHRLKNGFSNQMIINNVEVGNVIKSKLRSYPAHSHIPYPNCNQDLFNIEDKESTRKIRELLKKGNSLYSKVSDKVFQCLRDTNSRLGLGSELREDIKEKIINLGVYMHSSQWFEPFLFWFTVKTEMRSVIKSQTHTCHRRRHTPVFFTGSSVELLISRDLVAIISKESQHVYYLTFELVLMYCDVIEGRLMTETAMTIDARYAELLGRVRYMWKLIDGFFPALGNPTYQIVAMLEPLSLAYLQLRDITVELRGAFLNHCFTEIHDVLDQNGFSDEGTYHELIEALDYIFITDDIHLTGEIFSFFRSFGHPRLEAVTAAENVRKYMNQPKVIVYETLMKGHAIFCGIIINGYRDRHGGSWPPLTLPLHAADTIRNAQASGEGLTHEQCVDNWKSFAGVRFGCFMPLSLDSDLTMYLKDKALAALQREWDSVYPKEFLRYDPPKGTGSRRLVDVFLNDSSFDPYDMIMYVVSGAYLHDPEFNLSYSLKEKEIKETGRLFAKMTYKMRACQVIAENLISNGIGKYFKDNGMAKDEHDLTKALHTLAVSGVPKDLKESHRGGPVLKTYSRSPVHTSTRNVKAEKGFVGFPHVIRQNQDTDHPENIETYETVSAFITTDLKKYCLNWRYETISLFAQRLNEIYGLPSFFQWLHKRLETSVLYVSDPHCPPDLDAHVPLCKVPNDQIFIKYPMGGIEGYCQKLWTISTIPYLYLAAYESRVRIASLVQGDNQTIAVTKRVPSTWHYNLKKREAARVTRDYFVILRQRLHDIGHHLKANETIVSSHFFVYSKGIYYDGLLVSQSLKSIARCVFWSETIVDETRAACSNIATTMAKSIERGYDRYLAYSLNVLKVIQQILISLGFTINSTMTRDVVIPLLTNNDLLIRMALLPAPIGGMNYLNMSRLFVRNIGDPVTSSIADLKRMILASLMPEETLHQVMTQQPGDSSFLDWASDPYSANLVCVQSITRLLKNITARFVLIHSPNPMLKGLFHDDSKEEDERLAAFLMDRHIIVPRAAHEILDHSVTGARESIAGMLDTTKGLIRASMRKGGLTSRVITRLSNYDYEQFRAGMVLLTGRKRNVLIDKESCSVQLARALRSHMWARLARGRPIYGLEVPDVLESMRGHLIRRHETCVICECGSVNYGWFFVPSGCQLDDIDKETSSLRVPYIGSTTDERTDMKLAFVRAPSRSLRSAVRIATVYSWAYGDDDSSWNEAWLLARQRANVSLEELRVITPISTSTNLAHRLRDRSTQVKYSGTSLVRVARYTTISNDNLSFVISDKKVDTNFIYQQGMLLGLGVLETLFRLEKDTGSSNTVLHLHVETDCCVIPMIDHPRIPSSRKLELRAELCTNPLIYDNAPLIDRDATRLYTQSHRRHLVEFVTWSTPQLYHILAKSTALSMIDLVTKFEKDHMNEISALIGDDDINSFITEFLLIEPRLFTIYLGQCAAINWAFDVHYHRPSGKYQMGELLSSFLSRMSKGVFKVLVNALSHPKIYKKFWHCGIIEPIHGPSLDAQNLHTTVCNMVYTCYMTYLDLLLNEELEEFTFLLCESDEDVVPDRFDNIQAKHLCVLADLYCQPGTCPPIRGLRPVEKCAVLTDHIKAEARLSPAGSSWNINPIIVDHYSCSLTYLRRGSIKQIRLRVDPGFIFDALAEVNVSQPKVGSDVMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKGDVISNMSIKDFRPPHDDVAKLLKDINTSKHNLPISGGSLANYEIHAFRRIGLNSSACYKAVEISTLIRRCLEPGEDGLFLGEGSGSMLITYKEILKLNKCFYNSGVSANSRSGQRELAPYPSEVGLVEHRMGVGNIVKVLFNGRPEVTWVGSIDCFNFIVSNIPTSSVGFIHSDIETLPNKDTIEKLEELAAILSMALLLGKIGSILVIKLMPFSGDFVQGFISYVGSHYREVNLVYPRYSNFISTESYLVMTDLKANRLMNPEKIKQQIIESSVRTSPGLIGHILSIKQLSCIQAIVGGAVSRGDINPILKKLTPIEQVLISCGLAINGPKLCKELIHHDVASGQDGLLNSILILYRELARFKDNQRSQQGMFHAYPVLVSSRQRELVSRITRKFWGHILLYSGNRKLINRFIQNLKSGYLVLDLHQNIFVKNLSKSEKQIIMTGGLKREWVFKVTVKETKEWYKLVGYSALIKD

SEQ ID NO: 38 - protein, 2661 aa, Artificial Sequence
  Ln-DPK?DPN-Lc
MDSLSVNQILYPEVHLDSPIVTNKIVAILEYARVPHAYSLEDPTLCQNIKHRLKNGFSNQMIINNVEVGNVIKSKLRSYPAHSHIPYPNCNQDLFNIEDKESTRKIRELLKKGNSLYSKVSDKVFQCLRDTNSRLGLGSELREDIKEKIINLGVYMHSSQWFEPFLFWFTVKTEMRSVIKSQTHTCHRRRHTPVFFTGSSVELLISRDLVAIISKESQHVYYLTFELVLMYCDVIEGRLMTETAMTIDARYAELLGRVRYMWKLIDGFFPALGNPTYQIVAMLEPLSLAYLQLRDITVELRGAFLNHCFTEIHDVLDQNGFSDEGTYHELIEALDYIFITDDIHLTGEIFSFFRSFGHPRLEAVTAAENVRKYMNQPKVIVYETLMKGHAIFCGIIINGYRDRHGGSWPPLTLPLHAADTIRNAQASGEGLTHEQCVDNWKSFAGVRFGCFMPLSLDSDLTMYLKDKALAALQREWDSVYPKEFLRYDPPKGTGSRRLVDVFLNDSSFDPYDMIMYVVSGAYLHDPEFNLSYSLKEKEIKETGRLFAKMTYKMRACQVIAENLISNGIGKYFKDNGMAKDEHDLTKALHTLAVSGVPKDLKESHRGGPVLKTYSRSPVHTSTRNVKAEKGFVGFPHVIRQNQDTDHPENIETYETVSAFITTDLKKYCLNWRYETISLFAQRLNEIYGLPSFFQWLHKRLETSVLYVSDPHCPPDLDAHVPLCKVPNDQIFIKYPMGGIEGYCQKLWTISTIPYLYLAAYESRVRIASLVQGDNQTIAVTKRVPSTWHYNLKKREAARVTRDYFVILRQRLHDIGHHLKANETIVSSHFFVYSKGIYYDGLLVSQSLKSIARCVFWSETIVDETRAACSNIATTMAKSIERGYDRYLAYSLNVLKVIQQILISLGFTINSTMTRDVVIPLLTNNDLLIRMALLPAPIGGMNYLNMSRLFVRNIGDPVTSSIADLKRMILASLMPEETLHQVMTQQPGDSSFLDWASDPYSANLVCVQSITRLLKNITARFVLIHSPNPMLKGLFHDDSKEEDERLAAFLMDRHIIVPRAAHEILDHSVTGARESIAGMLDTTKGLIRASMRKGGLTSRVITRLSNYDYEQFRAGMVLLTGRKRNVLIDKESCSVQLARALRSHMWARLARGRPIYGLEVPDVLESMRGHLIRRHETCVICECGSVNYGWFFVPSGCQLDDIDKETSSLRVPYIGSTTDERTDMKLAFVRAPSRSLRSAVRIATVYSWAYGDDDSSWNEAWLLARQRANVSLEELRVITPISTSTNLAHRLRDRSTQVKYSGTSLVRVARYTTISNDNLSFVISDKKVDTNFIYQQGMLLGLGVLETLFRLEKDTGSSNTVLHLHVETDCCVIPMIDHPRIPSSRKLELRAELCTNPLIYDNAPLIDRDATRLYTQSHRRHLVEFVTWSTPQLYHILAKSTALSMIDLVTKFEKDHMNEISALIGDDDINSFITEFLLIEPRLFTIYLGQCAAINWAFDVHYHRPSGKYQMGELLSSFLSRMSKGVFKVLVNALSHPKIYKKFWHCGIIEPIHGPSLDAQNLHTTVCNMVYTCYMTYLDLLLNEELEEFTFLLCESDEDVVPDRFDNIQAKHLCVLADLYCQPGTCPPIRGLRPVEKCAVLTDHIKAEARLSPAGSSWNINPIIVDHYSCSLTYLRRGSIKQIRLRVDPGFIFDALAEVNVSQPKVGSDVMVSVIKPDMKIKLRMEGAVNGHPFAIEGVGLGKPFEGKQSMDLKVKEGGPLPFAYDILTTVFCYGNRVFAKYPENIVDYFKQSFPEGYSWERSMNYEDGGICNATNDITLDGDCYIYEIRFDGVNFPANGPVMQKRTVKWEPSTEKLYVRDGVLKGDVNMALSLEGGGHYRCDFKTTYKAKKVVQLPDYHFVDHHIEIKSHDKDYSNVNLHEHAEAHSELPRQAKTGNSADGGGGSGGSGGSGGGSTQGGSMVSVIKPDMKIKLRMEGAVNGHPFAIEGVGLGKPFEGKQSMDLKVKEGGPLPFAYDILTTVFCYGNRVFAKYPENIVDYFKQSFPEGYSWERSMNYEDGGICNATNDITLDGDCYIYEIRFDGVNFPANGPVMQKRTVKWEPSTENLYVRDGVLKGDVNMALSLEGGGHYRCDFKTTYKAKKVVQLPDYHFVDHHIEIKSHDKDYSNVNLHEHAEAHSELPRQAKDVISNMSIKDFRPPHDDVAKLLKDINTSKHNLPISGGSLANYEIHAFRRIGLNSSACYKAVEISTLIRRCLEPGEDGLFLGEGSGSMLITYKEILKLNKCFYNSGVSANSRSGQRELAPYPSEVGLVEHRMGVGNIVKVLFNGRPEVTWVGSIDCFNFIVSNIPTSSVGFIHSDIETLPNKDTIEKLEELAAILSMALLLGKIGSILVIKLMPFSGDFVQGFISYVGSHYREVNLVYPRYSNFISTESYLVMTDLKANRLMNPEKIKQQIIESSVRTSPGLIGHILSIKQLSCIQAIVGGAVSRGDINPILKKLTPIEQVLISCGLAINGPKLCKELIHHDVASGQDGLLNSILILYRELARFKDNQRSQQGMFHAYPVLVSSRQRELVSRITRKFWGHILLYSGNRKLINRFIQNLKSGYLVLDLHQNIFVKNLSKSEKQIIMTGGLKREWVFKVTVKETKEWYKLVGYSALIKD

SEQ ID NO: 39 - protein, 2521 aa, Artificial Sequence
  Ln-pMag-nMaghigh-Lc
MDSLSVNQILYPEVHLDSPIVTNKIVAILEYARVPHAYSLEDPTLCQNIKHRLKNGFSNQMIINNVEVGNVIKSKLRSYPAHSHIPYPNCNQDLFNIEDKESTRKIRELLKKGNSLYSKVSDKVFQCLRDTNSRLGLGSELREDIKEKIINLGVYMHSSQWFEPFLFWFTVKTEMRSVIKSQTHTCHRRRHTPVFFTGSSVELLISRDLVAIISKESQHVYYLTFELVLMYCDVIEGRLMTETAMTIDARYAELLGRVRYMWKLIDGFFPALGNPTYQIVAMLEPLSLAYLQLRDITVELRGAFLNHCFTEIHDVLDQNGFSDEGTYHELIEALDYIFITDDIHLTGEIFSFFRSFGHPRLEAVTAAENVRKYMNQPKVIVYETLMKGHAIFCGIIINGYRDRHGGSWPPLTLPLHAADTIRNAQASGEGLTHEQCVDNWKSFAGVRFGCFMPLSLDSDLTMYLKDKALAALQREWDSVYPKEFLRYDPPKGTGSRRLVDVFLNDSSFDPYDMIMYVVSGAYLHDPEFNLSYSLKEKEIKETGRLFAKMTYKMRACQVIAENLISNGIGKYFKDNGMAKDEHDLTKALHTLAVSGVPKDLKESHRGGPVLKTYSRSPVHTSTRNVKAEKGFVGFPHVIRQNQDTDHPENIETYETVSAFITTDLKKYCLNWRYETISLFAQRLNEIYGLPSFFQWLHKRLETSVLYVSDPHCPPDLDAHVPLCKVPNDQIFIKYPMGGIEGYCQKLWTISTIPYLYLAAYESRVRIASLVQGDNQTIAVTKRVPSTWHYNLKKREAARVTRDYFVILRQRLHDIGHHLKANETIVSSHFFVYSKGIYYDGLLVSQSLKSIARCVFWSETIVDETRAACSNIATTMAKSIERGYDRYLAYSLNVLKVIQQILISLGFTINSTMTRDVVIPLLTNNDLLIRMALLPAPIGGMNYLNMSRLFVRNIGDPVTSSIADLKRMILASLMPEETLHQVMTQQPGDSSFLDWASDPYSANLVCVQSITRLLKNITARFVLIHSPNPMLKGLFHDDSKEEDERLAAFLMDRHIIVPRAAHEILDHSVTGARESIAGMLDTTKGLIRASMRKGGLTSRVITRLSNYDYEQFRAGMVLLTGRKRNVLIDKESCSVQLARALRSHMWARLARGRPIYGLEVPDVLESMRGHLIRRHETCVICECGSVNYGWFFVPSGCQLDDIDKETSSLRVPYIGSTTDERTDMKLAFVRAPSRSLRSAVRIATVYSWAYGDDDSSWNEAWLLARQRANVSLEELRVITPISTSTNLAHRLRDRSTQVKYSGTSLVRVARYTTISNDNLSFVISDKKVDTNFIYQQGMLLGLGVLETLFRLEKDTGSSNTVLHLHVETDCCVIPMIDHPRIPSSRKLELRAELCTNPLIYDNAPLIDRDATRLYTQSHRRHLVEFVTWSTPQLYHILAKSTALSMIDLVTKFEKDHMNEISALIGDDDINSFITEFLLIEPRLFTIYLGQCAAINWAFDVHYHRPSGKYQMGELLSSFLSRMSKGVFKVLVNALSHPKIYKKFWHCGIIEPIHGPSLDAQNLHTTVCNMVYTCYMTYLDLLLNEELEEFTFLLCESDEDVVPDRFDNIQAKHLCVLADLYCQPGTCPPIRGLRPVEKCAVLTDHIKAEARLSPAGSSWNINPIIVDHYSCSLTYLRRGSIKQIRLRVDPGFIFDALAEVNVSQPKVGSDVSHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETETGNSADGGGGSGGSGGSGGGSTQGGSMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTIRKAIDRNAEVQVEVVNFKKNGQRFVNFLTIIPVRDETGEYRYSMGFQCETEYPYDVPDYAGISNMSIKDFRPPHDDVAKLLKDINTSKHNLPISGGSLANYEIHAFRRIGLNSSACYKAVEISTLIRRCLEPGEDGLFLGEGSGSMLITYKEILKLNKCFYNSGVSANSRSGQRELAPYPSEVGLVEHRMGVGNIVKVLFNGRPEVTWVGSIDCFNFIVSNIPTSSVGFIHSDIETLPNKDTIEKLEELAAILSMALLLGKIGSILVIKLMPFSGDFVQGFISYVGSHYREVNLVYPRYSNFISTESYLVMTDLKANRLMNPEKIKQQIIESSVRTSPGLIGHILSIKQLSCIQAIVGGAVSRGDINPILKKLTPIEQVLISCGLAINGPKLCKELIHHDVASGQDGLLNSILILYRELARFKDNQRSQQGMFHAYPVLVSSRQRELVSRITRKFWGHILLYSGNRKLINRFIQNLKSGYLVLDLHQNIFVKNLSKSEKQIIMTGGLKREWVFKVTVKETKEWYKLVGYSALIKD

SEQ ID NO: 40 - protein, 3001 aa, Artificial Sequence
  Ln-CRY2-CIB1N-Lc
MDSLSVNQILYPEVHLDSPIVTNKIVAILEYARVPHAYSLEDPTLCQNIKHRLKNGFSNQMIINNVEVGNVIKSKLRSYPAHSHIPYPNCNQDLFNIEDKESTRKIRELLKKGNSLYSKVSDKVFQCLRDTNSRLGLGSELREDIKEKIINLGVYMHSSQWFEPFLFWFTVKTEMRSVIKSQTHTCHRRRHTPVFFTGSSVELLISRDLVAIISKESQHVYYLTFELVLMYCDVIEGRLMTETAMTIDARYAELLGRVRYMWKLIDGFFPALGNPTYQIVAMLEPLSLAYLQLRDITVELRGAFLNHCFTEIHDVLDQNGFSDEGTYHELIEALDYIFITDDIHLTGEIFSFFRSFGHPRLEAVTAAENVRKYMNQPKVIVYETLMKGHAIFCGIIINGYRDRHGGSWPPLTLPLHAADTIRNAQASGEGLTHEQCVDNWKSFAGVRFGCFMPLSLDSDLTMYLKDKALAALQREWDSVYPKEFLRYDPPKGTGSRRLVDVFLNDSSFDPYDMIMYVVSGAYLHDPEFNLSYSLKEKEIKETGRLFAKMTYKMRACQVIAENLISNGIGKYFKDNGMAKDEHDLTKALHTLAVSGVPKDLKESHRGGPVLKTYSRSPVHTSTRNVKAEKGFVGFPHVIRQNQDTDHPENIETYETVSAFITTDLKKYCLNWRYETISLFAQRLNEIYGLPSFFQWLHKRLETSVLYVSDPHCPPDLDAHVPLCKVPNDQIFIKYPMGGIEGYCQKLWTISTIPYLYLAAYESRVRIASLVQGDNQTIAVTKRVPSTWHYNLKKREAARVTRDYFVILRQRLHDIGHHLKANETIVSSHFFVYSKGIYYDGLLVSQSLKSIARCVFWSETIVDETRAACSNIATTMAKSIERGYDRYLAYSLNVLKVIQQILISLGFTINSTMTRDVVIPLLTNNDLLIRMALLPAPIGGMNYLNMSRLFVRNIGDPVTSSIADLKRMILASLMPEETLHQVMTQQPGDSSFLDWASDPYSANLVCVQSITRLLKNITARFVLIHSPNPMLKGLFHDDSKEEDERLAAFLMDRHIIVPRAAHEILDHSVTGARESIAGMLDTTKGLIRASMRKGGLTSRVITRLSNYDYEQFRAGMVLLTGRKRNVLIDKESCSVQLARALRSHMWARLARGRPIYGLEVPDVLESMRGHLIRRHETCVICECGSVNYGWFFVPSGCQLDDIDKETSSLRVPYIGSTTDERTDMKLAFVRAPSRSLRSAVRIATVYSWAYGDDDSSWNEAWLLARQRANVSLEELRVITPISTSTNLAHRLRDRSTQVKYSGTSLVRVARYTTISNDNLSFVISDKKVDTNFIYQQGMLLGLGVLETLFRLEKDTGSSNTVLHLHVETDCCVIPMIDHPRIPSSRKLELRAELCTNPLIYDNAPLIDRDATRLYTQSHRRHLVEFVTWSTPQLYHILAKSTALSMIDLVTKFEKDHMNEISALIGDDDINSFITEFLLIEPRLFTIYLGQCAAINWAFDVHYHRPSGKYQMGELLSSFLSRMSKGVFKVLVNALSHPKIYKKFWHCGIIEPIHGPSLDAQNLHTTVCNMVYTCYMTYLDLLLNEELEEFTFLLCESDEDVVPDRFDNIQAKHLCVLADLYCQPGTCPPIRGLRPVEKCAVLTDHIKAEARLSPAGSSWNINPIIVDHYSCSLTYLRRGSIKQIRLRVDPGFIFDALAEVNVSQPKVGSDVKMDKKTIVWFRRDLRIEDNPALAAAAHEGSVFPVFIWCPEEEGQFYPGRASRWWMKQSLAHLSQSLKALGSDLTLIKTHNTISAILDCIRVTGATKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAAPDEIVADSFEALGANTIKEPGLCPSVSSNDQQVPSAVRYNGSAAVKPEEEEERDMKKSRGFDERELFSTAESSSSSSVFFVSQSCSLASEGKNLEGIQDSSDQITTSLGKNGCKTGNSADGGGGSGGSGGSGGGSTQGGSMNGAIGGDLLLNFPDMSVLERQRAHLKYLNPTFDSPLAGFFADSSMITGGEMDSYLSTAGLNLPMMYGETTVEGDSRLSISPETTLGTGNFKAAKFDTETKDCNEAAKKMTMNRDDLVEEGEEEKSKITEQNNGSTKSIKKMKHKAKKEENNFSNDSSKVTKELEKTDYIGYPYDVPDYAGISNMSIKDFRPPHDDVAKLLKDINTSKHNLPISGGSLANYEIHAFRRIGLNSSACYKAVEISTLIRRCLEPGEDGLFLGEGSGSMLITYKEILKLNKCFYNSGVSANSRSGQRELAPYPSEVGLVEHRMGVGNIVKVLFNGRPEVTWVGSIDCFNFIVSNIPTSSVGFIHSDIETLPNKDTIEKLEELAAILSMALLLGKIGSILVIKLMPFSGDFVQGFISYVGSHYREVNLVYPRYSNFISTESYLVMTDLKANRLMNPEKIKQQIIESSVRTSPGLIGHILSIKQLSCIQAIVGGAVSRGDINPILKKLTPIEQVLISCGLAINGPKLCKELIHHDVASGQDGLLNSILILYRELARFKDNQRSQQGMFHAYPVLVSSRQRELVSRITRKFWGHILLYSGNRKLINRFIQNLKSGYLVLDLHQNIFVKNLSKSEKQIIMTGGLKREWVFKVTVKETKEWYKLVGYSALIKD

SEQ ID NO: 41 - protein, 2887 aa, Artificial Sequence
  Ln-CRY2PHR-CIB1N-Lc
MDSLSVNQILYPEVHLDSPIVTNKIVAILEYARVPHAYSLEDPTLCQNIKHRLKNGFSNQMIINNVEVGNVIKSKLRSYPAHSHIPYPNCNQDLFNIEDKESTRKIRELLKKGNSLYSKVSDKVFQCLRDTNSRLGLGSELREDIKEKIINLGVYMHSSQWFEPFLFWFTVKTEMRSVIKSQTHTCHRRRHTPVFFTGSSVELLISRDLVAIISKESQHVYYLTFELVLMYCDVIEGRLMTETAMTIDARYAELLGRVRYMWKLIDGFFPALGNPTYQIVAMLEPLSLAYLQLRDITVELRGAFLNHCFTEIHDVLDQNGFSDEGTYHELIEALDYIFITDDIHLTGEIFSFFRSFGHPRLEAVTAAENVRKYMNQPKVIVYETLMKGHAIFCGIIINGYRDRHGGSWPPLTLPLHAADTIRNAQASGEGLTHEQCVDNWKSFAGVRFGCFMPLSLDSDLTMYLKDKALAALQREWDSVYPKEFLRYDPPKGTGSRRLVDVFLNDSSFDPYDMIMYVVSGAYLHDPEFNLSYSLKEKEIKETGRLFAKMTYKMRACQVIAENLISNGIGKYFKDNGMAKDEHDLTKALHTLAVSGVPKDLKESHRGGPVLKTYSRSPVHTSTRNVKAEKGFVGFPHVIRQNQDTDHPENIETYETVSAFITTDLKKYCLNWRYETISLFAQRLNEIYGLPSFFQWLHKRLETSVLYVSDPHCPPDLDAHVPLCKVPNDQIFIKYPMGGIEGYCQKLWTISTIPYLYLAAYESRVRIASLVQGDNQTIAVTKRVPSTWHYNLKKREAARVTRDYFVILRQRLHDIGHHLKANETIVSSHFFVYSKGIYYDGLLVSQSLKSIARCVFWSETIVDETRAACSNIATTMAKSIERGYDRYLAYSLNVLKVIQQILISLGFTINSTMTRDVVIPLLTNNDLLIRMALLPAPIGGMNYLNMSRLFVRNIGDPVTSSIADLKRMILASLMPEETLHQVMTQQPGDSSFLDWASDPYSANLVCVQSITRLLKNITARFVLIHSPNPMLKGLFHDDSKEEDERLAAFLMDRHIIVPRAAHEILDHSVTGARESIAGMLDTTKGLIRASMRKGGLTSRVITRLSNYDYEQFRAGMVLLTGRKRNVLIDKESCSVQLARALRSHMWARLARGRPIYGLEVPDVLESMRGHLIRRHETCVICECGSVNYGWFFVPSGCQLDDIDKETSSLRVPYIGSTTDERTDMKLAFVRAPSRSLRSAVRIATVYSWAYGDDDSSWNEAWLLARQRANVSLEELRVITPISTSTNLAHRLRDRSTQVKYSGTSLVRVARYTTISNDNLSFVISDKKVDTNFIYQQGMLLGLGVLETLFRLEKDTGSSNTVLHLHVETDCCVIPMIDHPRIPSSRKLELRAELCTNPLIYDNAPLIDRDATRLYTQSHRRHLVEFVTWSTPQLYHILAKSTALSMIDLVTKFEKDHMNEISALIGDDDINSFITEFLLIEPRLFTIYLGQCAAINWAFDVHYHRPSGKYQMGELLSSFLSRMSKGVFKVLVNALSHPKIYKKFWHCGIIEPIHGPSLDAQNLHTTVCNMVYTCYMTYLDLLLNEELEEFTFLLCESDEDVVPDRFDNIQAKHLCVLADLYCQPGTCPPIRGLRPVEKCAVLTDHIKAEARLSPAGSSWNINPIIVDHYSCSLTYLRRGSIKQIRLRVDPGFIFDALAEVNVSQPKVGSDVKMDKKTIVWFRRDLRIEDNPALAAAAHEGSVFPVFIWCPEEEGQFYPGRASRWWMKQSLAHLSQSLKALGSDLTLIKTHNTISAILDCIRVTGATKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAATGNSADGGGGSGGSGGSGGGSTQGGSMNGAIGGDLLLNFPDMSVLERQRAHLKYLNPTFDSPLAGFFADSSMITGGEMDSYLSTAGLNLPMMYGETTVEGDSRLSISPETTLGTGNFKAAKFDTETKDCNEAAKKMTMNRDDLVEEGEEEKSKITEQNNGSTKSIKKMKHKAKKEENNFSNDSSKVTKELEKTDYIGYPYDVPDYAGISNMSIKDFRPPHDDVAKLLKDINTSKHNLPISGGSLANYEIHAFRRIGLNSSACYKAVEISTLIRRCLEPGEDGLFLGEGSGSMLITYKEILKLNKCFYNSGVSANSRSGQRELAPYPSEVGLVEHRMGVGNIVKVLFNGRPEVTWVGSIDCFNFIVSNIPTSSVGFIHSDIETLPNKDTIEKLEELAAILSMALLLGKIGSILVIKLMPFSGDFVQGFISYVGSHYREVNLVYPRYSNFISTESYLVMTDLKANRLMNPEKIKQQIIESSVRTSPGLIGHILSIKQLSCIQAIVGGAVSRGDINPILKKLTPIEQVLISCGLAINGPKLCKELIHHDVASGQDGLLNSILILYRELARFKDNQRSQQGMFHAYPVLVSSRQRELVSRITRKFWGHILLYSGNRKLINRFIQNLKSGYLVLDLHQNIFVKNLSKSEKQIIMTGGLKREWVFKVTVKETKEWYKLVGYSALIKD

SEQ ID NO: 42 - DNA, 37 bp, Artificial Sequence
  hummer head type ribozime
ctgatgaggccgaaaggccgaaactccgtaaggagtc

SEQ ID NO: 43 - DNA, 109 bp, Artificial Sequence
  measle virus genome 5' terminal sequence
accagacaaagctgggaatagaaacttcgtattttcaaagttttctttaatatattgcaaataatgcctaaccacctagggcaggattagggttccggagttcaaccaa

SEQ ID NO: 44 - DNA, 600 bp, Artificial Sequence
  nano luc sequence
ttacgccagaatgcgttcgcacagccgccagccggtcactccgttgatggttactcggaacagcagggagccgtcggggttgatcaggcgctcgtcgataattttgttgccgttccacagggtccctgttacagtgatctttttgccgtcgaacacggcgatgccttcatacggccgtccgaaatagtcgatcatgttcggcgtaaccccgtcgattaccagtgtgccatagtgcaggatcaccttaaagtgatgatcatccacagggtacaccaccttaaaaattttttcgatctggcccatttggtcgccgctcagaccttcatacgggatgatgacatggatgtcgatcttcagcccattttcaccgctcaggacaatcctttggatcggagttacggacaccccgagattctgaaacaaactggacacacctccctgttcaaggacttggtccaggttgtagccggctgtctgtcgccagtccccaacgaaatcttcgagtgtgaagactggggcagggaaggcagcaggcaacaccaggagcaggcccagggagaaggcaactggaccgaaggcgcttgtggagaaggagttcat

SEQ ID NO: 45 - DNA, 107 bp, Artificial Sequence
  measle virus genome 3' terminal sequence
ctcggatatccctaatcctgctcttgtccctgataataggatcttgaatcctaagtgcactagaagatgatcattgattgaactatccttacccaactttgtttggt

SEQ ID NO: 46 - DNA, 82 bp, Artificial Sequence
  HDV ribozime sequence
gggtcggcatggcatctccacctcctcgcggtccgacctgggcatccgaaggagacgtcgtccactcggatggctaagggag

SEQ ID NO: 47 - DNA, 7286 bp, Artificial Sequence
  measle virus mini genome expression plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgctagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattctctaggcttggtaccgagctcggatcccctgtaatacgactcactatagggtgtctggtctgatgaggccgaaaggccgaaactccgtaaggagtcaccagacaaagctgggaatagaaacttcgtattttcaaagttttctttaatatattgcaaataatgcctaaccacctagggcaggattagggttccggagttcaaccaattacgccagaatgcgttcgcacagccgccagccggtcactccgttgatggttactcggaacagcagggagccgtcggggttgatcaggcgctcgtcgataattttgttgccgttccacagggtccctgttacagtgatctttttgccgtcgaacacggcgatgccttcatacggccgtccgaaatagtcgatcatgttcggcgtaaccccgtcgattaccagtgtgccatagtgcaggatcaccttaaagtgatgatcatccacagggtacaccaccttaaaaattttttcgatctggcccatttggtcgccgctcagaccttcatacgggatgatgacatggatgtcgatcttcagcccattttcaccgctcaggacaatcctttggatcggagttacggacaccccgagattctgaaacaaactggacacacctccctgttcaaggacttggtccaggttgtagccggctgtctgtcgccagtccccaacgaaatcttcgagtgtgaagactggggcagggaaggcagcaggcaacaccaggagcaggcccagggagaaggcaactggaccgaaggcgcttgtggagaaggagttcatctcggatatccctaatcctgctcttgtccctgataataggatcttgaatcctaagtgcactagaagatgatcattgattgaactatccttacccaactttgtttggtgggtcggcatggcatctccacctcctcgcggtccgacctgggcatccgaaggagacgtcgtccactcggatggctaagggagactagtccgctgagcaataactagcataaccccttggggcctctaaacgggtcttgaggggttttttgctgaaaggtttaaactataaacactagtccgctgagcaataactagcataaccccttggggcctctaaacgggtcttgaggggttttttgctgaaaggaggaactatatccgggcttcctcgctcactgactcgctgcgctcggtcgttcggctgcggcgagcggtatcagctcactcaaaggcggtaatacggttatccacagaatcaagcttactagtaacggccgccagtgtgctggaattctgcagatatccatcacactggcggccgctcgagcatgcatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 48 - DNA, 6515 bp, Artificial Sequence
  pCA7-IC-N
gtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggggggccgcgcgccagccggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcgggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattattaatacgactcactatagggagacccaagcttggtaccgagctcggatccactagtaacggccgccagtgtgctggaattctggctaatggccacacttttgaggagcttagcattgttcaaaagaaacaaggacaaaccacccattacatcaggatccggtggagccatcagaggaatcaaacacattattatagtaccaattcctggagattcctcaattaccactcgatccagactactggaccggttggtcaggttaattggaaacccggatgtgagcgggcccaaactaacaggggcactaataggtatattatccttatttgtggagtctccaggtcaattgattcagaggatcaccgatgaccctgacgttagcatcaggctgttagaggttgttcagagtgaccagtcacaatctggccttaccttcgcatcaagaggtaccaacatggaggatgaggcggaccaatacttttcacatgatgatccaagcagtagtgatcaatccaggtccggatggttcgagaacaaggaaatctcagatattgaagtgcaagaccctgagggattcaacatgattctgggtaccattctagcccagatctgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctctttacgccgattcatggtggctctaatcctggatatcaagaggacacccgggaacaaacctaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaatctttaccagcaaatgggagaaactgcaccctacatggtaatcctagagaactcaattcagaacaagttcagtgcaggatcataccctctgctctggagctatgccatgggagtaggagtggaacttgaaaactccatgggaggtttgaactttggtcgatcttactttgatccagcatattttagattagggcaagagatggtgaggaggtcagctggaaaggtcagttccacattggcatccgaactcggtatcactgccgaggatgcaaggcttgtttcagagattgcaatgcatactactgaggacaggatcagtagagcggtcggacccagacaagcccaagtgtcatttctacacggtgatcaaagtgagaatgagctaccaggattggggggcaaggaagataggagggtcaaacagggtcggggagaagccagggagagctacagagaaaccgggtccagcagagcaagtgatgcgagagctgcccatcctccaaccagcatgcccctagacattgacactgcatcggagtcaggccaagatccgcaggacagtcgaaggtcagctgacgccctgctcaggctgcaagccatggcaggaatcttggaagaacaaggctcagacacggacacccctagggtatacaatgacagagatcttctagactaggtgcgagagatccatcacactggcggccgctcgagcatgcatctagaggatctttgtgaaggaaaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggtggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatgaagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatggtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 49 - DNA, 6453 bp, Artificial Sequence
  pCA7-IC-PdeltaC
gtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggggggccgcgcgccagccggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcgggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattattaatacgactcactatagggagacccaagcttggtaccgagctcggatccactagtaacggccgccagtgtgctggaattccgatggcagaagagcaggcacgccatgtgaaaaacggactagaatgcatccgggctctcaaggccgagcccatcggctcactggccgtcgaggaagccatggcagcatggtcagaaatatcagacaacccaggacaggaccgagccacctgcaaggaagaggaggcaggcagttcgggtctcagcaaaccatgcctctcagcaattggatcaactgaaggcggtgcacctcgcatccgcggtcagggatctggagaaagcgatgacgacgctgaaactttgggaatcccctcaagaaatctccaggcatcaagcactgggttacagtgttatcatgtttatgatcacagcggtgaagcggttaagggaatccaagatgctgactctatcatggttcaatcaggccttgatggtgatagcaccctctcaggaggagacgatgaatctgaaaacagcgatgtggatattggcgaacctgataccgagggatatgctatcactgaccggggatctgctcccatctctatggggttcagggcttctgatgttgaaactgcagaaggaggggagatccacgagctcctgaaactccaatccagaggcaacaactttccgaagcttgggaaaactctcaatgttcctccgcccccgaaccccagtagggccagcacttccgagacacccattaaaaagggcacagacgcgagattggcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctccgatgtccaagacatcaaaacagccttggccaaaatacacgaggataatcagaagataatctccaagctagaatcattgctgttattgaagggagaagttgagtcaattaagaagcagatcaacaggcaaaatatcagcatatccaccctggaaggacacctctcaagcatcatgattgccattcctggacttgggaaggatcccaacgaccccactgcagatgtcgaactcaatcccgacctgaaacccatcataggcagagattcaggccgagcactggccgaagttctcaagaagcccgttgccagccgacaactccagggaatgactaatggacggaccagttccagaggacagctgctgaaggaatttcaactaaagccgatcgggaaaaaggtgagctcagccgtcgggtttgttcctgacaccggccctgcatcacgcagtgtaatccgctccattataaaatccagccggctagaggaggatcggaagcgttacctgatgactctccttgatgatatcaaaggagccaacgatcttgccaagttccaccagatgctgatgaagataataatgaagtagctacagctcaacttacctgcggccgctcgagcatgcatctagaggatctttgtgaaggaaaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggtggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatgaagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatggtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 50 - DNA, 11487 bp, Artificial Sequence
  pCA7-9301B-wtL
gtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggggggccgcgcgccagccggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcgggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattattaatacgactcactatagggagacccaagcttggtaccgagctcggatccactagtaacggccgccagtgtgctggaattcatggactcgctatctgtcaaccagatcctataccctgaagttcacctagatagcccgatagttaccaataagatagtagctatcctggagtatgctcgagtccctcacgcttacagcctggaggaccctacactgtgtcagaacatcaagcaccgcctaaaaaacggattctccaaccaaatgattataaacaatgtggaagttgggaatgtcatcaagtccaagcttaggagttatccggcccactctcatattccatatccaaattgtaatcaggatttatttaacatagaagacaaagagtcaacaaggaagatccgtgagctcctaaaaaagggaaattcgctgtactccaaggtcagtgataaggttttccaatgcctgagggacactaattcacggcttggcttaggctctgaattgagagaggacatcaaggagaaaattattaacttgggagtttacatgcacagctcccaatggtttgagccctttctgttttggtttacagtcaagactgagatgaggtcagtgatcaaatcacaaacccatacttgccataggaggagacacacacctgtattcttcactggtagttcagttgagctgttaatctctcgtgaccttgttgctataattagtaaagagtctcaacatgtatattacctgacgtttgaactggttttgatgtattgtgatgtcatagaggggaggttaatgacagagaccgctatgaccattgatgctaggtatgcagaacttctaggaagagtcagatacatgtggaaactgatagatggtttcttccctgcactcgggaacccaacttatcaaattgtagccatgctggagccactttcacttgcttacctgcaactgagggatataacagtagaactcagaggtgctttccttaaccactgctttactgaaatacatgatgttcttgaccaaaacgggttttctgatgaaggtacttatcatgagttaattgaagccctagattacattttcataactgatgacatacatttgacaggggagattttctcatttttcagaagtttcggccaccccagacttgaagcagtaacggctgctgaaaatgttaggaaatacatgaatcagcctaaagtcattgtgtatgagactctgatgaaaggtcatgccatattttgtggaatcataatcaacggctatcgtgacaggcacggaggcagttggccacccctgaccctccccctgcatgctgcagacacaatccggaatgcccaagcctcaggcgaagggttaacacatgagcagtgcgttgataactggaaatcatttgctggagtgagatttggctgttttatgcctcttagcctggacagtgatctgacaatgtacctaaaggacaaggcacttgctgctctccaaagggaatgggattcagtttacccgaaagagtttctgcgttacgatcctcccaagggaaccgggtcacggaggcttgtagatgttttccttaatgattcgagctttgacccatatgatatgataatgtatgtcgtaagtggagcttacctccatgactctgagttcaacctgtcttacagcctgaaagaaaaggagatcaaggaaacaggtagactttttgctaaaatgacttacaaaatgagggcatgccaagtgattgctgaaaatctaatctcaaacgggattggcaaatattttaaggacaatgggatggccaaggatgagcacgatttgaccaaggcactccacactctagctgtctcaggagtccccaaagatctcaaagaaagtcacaggggggggccagtcttaaaaacctactcccgaagcccagtccacacaagtaccaggaacgttaaagcagcaaaagggtttgtaggattccctcatgtaattcgggagaatcaagacactgatcatccggagaatatagaaacttacgagacagtcagcgcatttatcacgactgatctcaagaagtactgccttaattggagatatgagaccatcagcttatttgcacagaggctaaatgagatttacggattaccctcattttttcagtggctgcataagaggcttgaaacctctgtcctctatgtaagtgaccctcattgcccccccgaccttgacgcccatgtcccgttatgcaaagtccctaatgaccaaatcttcatcaagtaccctatgggaggcatagaagggtattgtcagaagttgtggaccatcagcaccattccctacttatacctggctgcttatgagagcggagtaaggattgcttcgttagtgcaaggggacaatcagaccatagccgtaacaaaaagggtacccagcacatggccttacaaccttaagaaacgggaagctgctagagtaactagagattactttgtaattcttaggcaaaggctacatgacattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcggcatgcagtaatattgctacaacaatggccaaaagcattgagagaggttatgaccgttatcttgcatattccctgaacgtcctaaaagtgatacagcaaattttgatctcccttggcttcacaatcaattcaaccatgacccgggatgtagtcatacccctcctcacaaacaacgatctcttaataaggatggcactgttgcccgctcctattgggggtatgaattatctgaatatgagcaggctgtttgtcagaaacatcggtgatccagtaacatcatcaattgctgatctcaagagaatgattctcgcatcactaatgcctgaagagaccctccatcaagtaatgacacaacaaccgggggactcttcattcctagactgggctagcgacccttactcagcaaatcttgtatgcgtccagagcatcactagactcctcaagaacataactgcaaggtttgtcctgatccacagtccaaacccaatgttaaaagggttattccatgatgacagcaaagaagaggacgagagactggcggcattcctcatggacaggcatattatagtacctagggcagctcatgaaatcctggatcatagtgtcacaggggcaagagagtctattgcaggcatgctagataccacaaaaggcctgattcgagccagcatgaggaaaggggggttaacctctcgagtgataaccagattgtccaattatgactatgaacaatttagagcagggatggtgctattgacaggaagaaagagaaatgtcctcattgacaaagagtcatgttcagttcaactggctagagccctaagaagccatatgtgggcaagactagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagctcgccttcgtaagagccccaagtcgatccttgcgatctgctgttagaatagcaacagtgtactcatgggcttacggtgatgatgatagttcttggaacgaagcctggttgttggcaaggcaaagggccaatgtgagcctggaggagctaagggtgatcactcccatctcaacttcgactaatttagcgcataggttgagggatcgtagcactcaagtgaaatactcaggtacatcccttgtccgagtggcaaggtataccacaatctccaacgacaatctctcatttgtcatatcagataagaaggttgatactaactttatataccaacaaggaatgcttctagggttgggtgttttagaaacattgtttcgactcgagaaagatactggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattctagctaagtccacagcactatctatgattgacctggtaacaaaatttgagaaggaccatatgaatgaaatttcagctctcataggggatgacgatatcaatagtttcataactgagtttctgcttatagagccaagattattcactatctacttgggccagtgtgcagccatcaattgggcatttgatatacattatcatagaccatcagggaaatatcagatgggtgagctgttgtcttcgttcctttctagaatgagcaaaggagtgtttaaggtgcttgtcaatgctctaagccacccaaagatctacaagaaattctggcactgtggtattatagagcctatccatggtccttcacttgatgctcaaaacttgcacacaactgtgtgcaacatggtttacacatgctatatgacctacctcgacctgttgttgaatgaagagttagaagagttcacatttcttttgtgtgaaagcgacgaggatgtagtaccggacagattcgacaacatccaggcaaaacacttgtgtgttctagcagatttgtactgtcaaccagggacctgcccaccgattcgaggtctaagaccggtagagaaatgtgcagttctaaccgatcatatcaaggcagaggctaggttatctccagcagggtcttcgtggaacataaatccaattattgtagaccattactcatgctctctgacttatctccggcggggatctatcaaacagataagattgagagttgatccgggattcatttttgacgccctcgctgaggtaaatgtcagtcaaccaaagatcggcagcaacaacatctcaaatatgagcatcaaggatttcagacctccacacgatgatgttgcaaaactgctcaaagatatcaacacaagcaagcacaatcttcccatttcagggggtagtctcgccaattatgaaatccatgctttccgcaggatcgggttaaactcatctgcttgctacaaagctgttgagatatcaacattaattaggagatgccttgagccaggggaagacggcttgttcttgggtgaggggtcgggttctatgttgatcacttataaggagatactaaaactaaacaagtgcttctataatagtggggtttccgccaattctagatctggtcaaagggaattagcaccctatccctccgaagttggccttgtcgaacacagaatgggagtaggtaatattgtcaaagtgctctttaacgggaggcccgaagtcacgtgggtaggcagtatagattgcttcaatttcatagtcagtaacatccctacctctagtgtggggtttatccattcagatatagagaccttacctaacaaagatactatagagaagctagaggaattggcagccatcttatcgatggctctgctccttggcaaaataggatcaatactggtgattaagcttatgcctttaagcggggattttgttcagggatttataagctatgtagggtctcattatagagaagtgaaccttgtttaccctaggtacagcaacttcatatctactgaatcttatttagttatgacagatctcaaagctaaccggctaataaatcctgaaaagattaagcagcagataatcgaatcatctgtgcggacttcacctggacttataggtcacatcctatccattaagcaactaagctgcatacaagcaattgtgggaggcgcagttagtagaggtgatatcaaccctactctgaaaaaacttacacctatagagcaggtgctgatcagttgcgggttgacaattaacggacctaaactgtgcaaagaattaatccaccatgatgttgcctcagggcaagatggattgcttaactctatactcatcctctacagggagttggcaagattcaaagacaaccaaagaagtcaacaagggatgttccacgcttaccccgtattggtaagtagcaggcaacgagaacttgtatctaggatcacccgcaaattttgggggcatattcttctttactccgggaacagaaagttgataaatcggtttatccagaatctcaaatccggttatctaatactagacttacaccagaatatcttcgttaagaatctatctaagtcagagaaacagattattatgacggggggtttaaaacgtgagtgggtttttaaggtaacagtcaaggagaccaaagaatggtataagttggtcggatacagtgccctgattaaggattaagaattctgcagatatccatcacactggcggccgctcgagcatgcatctagaggatctttgtgaaggaaaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggtggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatgaagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatggtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 51 - DNA, 12501 bp, Artificial Sequence
  pCA7-9301B-L-pMag-nMaghigh
gtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggggggccgcgcgccagccggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcgggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattattaatacgactcactatagggagacccaagcttggtaccgagctcggatccactagtaacggccgccagtgtgctggaattcatggactcgctatctgtcaaccagatcctataccctgaagttcacctagatagcccgatagttaccaataagatagtagctatcctggagtatgctcgagtccctcacgcttacagcctggaggaccctacactgtgtcagaacatcaagcaccgcctaaaaaacggattctccaaccaaatgattataaacaatgtggaagttgggaatgtcatcaagtccaagcttaggagttatccggcccactctcatattccatatccaaattgtaatcaggatttatttaacatagaagacaaagagtcaacaaggaagatccgtgagctcctaaaaaagggaaattcgctgtactccaaggtcagtgataaggttttccaatgcctgagggacactaattcacggcttggcttaggctctgaattgagagaggacatcaaggagaaaattattaacttgggagtttacatgcacagctcccaatggtttgagccctttctgttttggtttacagtcaagactgagatgaggtcagtgatcaaatcacaaacccatacttgccataggaggagacacacacctgtattcttcactggtagttcagttgagctgttaatctctcgtgaccttgttgctataattagtaaagagtctcaacatgtatattacctgacgtttgaactggttttgatgtattgtgatgtcatagaggggaggttaatgacagagaccgctatgaccattgatgctaggtatgcagaacttctaggaagagtcagatacatgtggaaactgatagatggtttcttccctgcactcgggaacccaacttatcaaattgtagccatgctggagccactttcacttgcttacctgcaactgagggatataacagtagaactcagaggtgctttccttaaccactgctttactgaaatacatgatgttcttgaccaaaacgggttttctgatgaaggtacttatcatgagttaattgaagccctagattacattttcataactgatgacatacatttgacaggggagattttctcatttttcagaagtttcggccaccccagacttgaagcagtaacggctgctgaaaatgttaggaaatacatgaatcagcctaaagtcattgtgtatgagactctgatgaaaggtcatgccatattttgtggaatcataatcaacggctatcgtgacaggcacggaggcagttggccacccctgaccctccccctgcatgctgcagacacaatccggaatgcccaagcctcaggcgaagggttaacacatgagcagtgcgttgataactggaaatcatttgctggagtgagatttggctgttttatgcctcttagcctggacagtgatctgacaatgtacctaaaggacaaggcacttgctgctctccaaagggaatgggattcagtttacccgaaagagtttctgcgttacgatcctcccaagggaaccgggtcacggaggcttgtagatgttttccttaatgattcgagctttgacccatatgatatgataatgtatgtcgtaagtggagcttacctccatgactctgagttcaacctgtcttacagcctgaaagaaaaggagatcaaggaaacaggtagactttttgctaaaatgacttacaaaatgagggcatgccaagtgattgctgaaaatctaatctcaaacgggattggcaaatattttaaggacaatgggatggccaaggatgagcacgatttgaccaaggcactccacactctagctgtctcaggagtccccaaagatctcaaagaaagtcacaggggggggccagtcttaaaaacctactcccgaagcccagtccacacaagtaccaggaacgttaaagcagcaaaagggtttgtaggattccctcatgtaattcgggagaatcaagacactgatcatccggagaatatagaaacttacgagacagtcagcgcatttatcacgactgatctcaagaagtactgccttaattggagatatgagaccatcagcttatttgcacagaggctaaatgagatttacggattaccctcattttttcagtggctgcataagaggcttgaaacctctgtcctctatgtaagtgaccctcattgcccccccgaccttgacgcccatgtcccgttatgcaaagtccctaatgaccaaatcttcatcaagtaccctatgggaggcatagaagggtattgtcagaagttgtggaccatcagcaccattccctacttatacctggctgcttatgagagcggagtaaggattgcttcgttagtgcaaggggacaatcagaccatagccgtaacaaaaagggtacccagcacatggccttacaaccttaagaaacgggaagctgctagagtaactagagattactttgtaattcttaggcaaaggctacatgacattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcggcatgcagtaatattgctacaacaatggccaaaagcattgagagaggttatgaccgttatcttgcatattccctgaacgtcctaaaagtgatacagcaaattttgatctcccttggcttcacaatcaattcaaccatgacccgggatgtagtcatacccctcctcacaaacaacgatctcttaataaggatggcactgttgcccgctcctattggggggatgaattatctgaatatgagcaggctgtttgtcagaaacatcggtgatccagtaacatcatcaattgctgatctcaagagaatgattctcgcatcactaatgcctgaagagaccctccatcaagtaatgacacaacaaccgggggactcttcattcctagactgggctagcgacccttactcagcaaatcttgtatgcgtccagagcatcactagactcctcaagaacataactgcaaggtttgtcctgatccacagtccaaacccaatgttaaaagggttattccatgatgacagcaaagaagaggacgagagactggcggcattcctcatggacaggcatattatagtacctagggcagctcatgaaatcctggatcatagtgtcacaggggcaagagagtctattgcaggcatgctagataccacaaaaggcctgattcgagccagcatgaggaagggggggttaacctctcgagtgataaccagattgtccaattatgactatgaacaatttagagcagggatggtgctattgacaggaagaaagagaaatgtcctcattgacaaagagtcatgttcagtgcagctggctagagccctaagaagccatatgtgggcaagactagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagctcgccttcgtaagagccccaagtagatccttgcgatctgccgttagaatagcaacagtgtactcatgggcttacggtgatgatgatagctcttggaacgaagcctggttgttggcaaggcaaagggccaatgtgagcctggaggagctaagggtgatcactcccatctcgacttcgactaatttagcgcataggttgagggatcgtagcactcaagtgaaatactcaggtacatcccttgtccgagtggcaaggtataccacaatctccaacgacaatctctcatttgtcatatcagataagaaggttgatactaactttatataccaacaaggaatgcttctagggttgggtgttttagaaacattgtttcgactcgagaaagatactggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattctagctaagtccacagcactatctatgattgacctggtaacaaaatttgagaaggaccatatgaatgaaatttcagctctcataggggatgacgatatcaatagtttcataactgagtttctgcttatagagccaagattattcaccatctacttgggccagtgtgcagccatcaattgggcatttgatgtacattatcatagaccatcagggaaatatcagatgggtgagctgttgtcttcgttcctttctagaatgagcaaaggagtgtttaaggtgcttgtcaatgctctaagccacccaaagatctacaagaaattctggcattgtggtattatagagcctatccatggtccttcacttgatgctcaaaacttgcacacaactgtgtgcaacatggtttacacatgctatatgacctacctcgacctgttgttgaatgaagagttagaagagttcacatttcttttgtgtgaaagcgatgaggatgtagtaccggacagattcgacaacatccaggcaaaacacttgtgtgttctggcagatttgtactgtcaaccagggacctgcccaccgattcgaggtctaaggccggtagagaaatgtgcagttctaaccgatcatatcaaggcagaggctaggttatctccagcaggatcttcgtggaacataaatccaattattgtagaccattactcatgctctctgacttatctccgtcgaggatctatcaaacagataagattgagagttgatccaggattcatttttgacgccctcgctgaggtaaatgtcagtcagccaaaggtcggcagcgacgtcagccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaaaccggtaattccgctgacggcggcggaggatcgggtggtagtggtggttcaggaggaggatcgacccaaggaggatccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatccgcaaggcaatcgacaggaatgccgaggtgcaggttgaagtagtcaattttaaaaagaatggacagcgatttgttaatttcctgactatcatacctgttagggacgaaacaggcgagtatcgatactctatgggattccagtgcgaaacagaatatccgtacgacgtcccagattacgcgggcatctcaaatatgagcatcaaggatttcagacctccacacgatgatgttgcaaaattgctcaaagatatcaacacaagcaagcacaatcttcccatttcagggggtagtctcgccaattatgaaatccatgctttccgcagaatcgggttaaactcatctgcttgctacaaagctgttgagatatcaacattaattaggagatgccttgagccaggggaagacggcttgttcttgggtgaggggtcgggttctatgttgatcacttataaggagatactaaaactaaacaagtgcttctataatagtggggtttccgccaattctagatctggtcaaagggaattagcaccctatccctccgaagttggccttgtcgaacacagaatgggagtaggtaatattgtcaaggtgctctttaacgggaggcccgaagtcacgtgggtaggcagtatagattgcttcaatttcatagtcagtaatatccctacctctagtgtggggtttatccattcagatatagagaccttacctaacaaagatactatagagaagctagaggaattggcagccatcttatcgatggctctgctccttggcaaaataggatcaatactggtgattaagcttatgcctttaagcggggattttgttcagggatttataagctatgtagggtctcattatagagaagtgaaccttgtttaccctaggtacagcaacttcatatctactgaatcttatttagttatgacagatctcaaagctaaccggctaataaatcctgaaaagattaagcagcagataatcgaatcatctgtgcggacttcacctggacttataggtcacatcctatccattaagcaactaagctgcatacaagcaattgtgggaggcgcagttagtagaggtgatatcaaccctactctgaaaaaacttacacctatagagcaggtgctgatcagttgcgggttgacaattaacggacctaaactgtgcaaagaattaatccaccatgatgttgcctcagggcaagatggattgcttaactctatactcatcctctacagggagttggcaagattcaaagacaaccaaagaagtcaacaagggatgttccacgcttaccccgtattggtaagtagcaggcaacgagaacttgtatctaggatcacccgcaaattttgggggcatattcttctttactccgggaacagaaagttgataaatcggtttatccagaatctcaaatccggttatctaatactagacttacaccagaatatcttcgttaagaatctatctaagtcagagaaacagattattatgacggggggtttaaaacgtgagtgggtttttaaggtaacagtcaaggagaccaaagaatggtataagttggtcggatacagtgccctgattaaggattaagaattctgcagatatccatcacactggcggccgctcgagcatgcatctagaggatctttgtgaaggaaaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggtggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatgaagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatggtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 52 - DNA, 15969 bp, Artificial Sequence
  pHEP+EGFP
acgcttaacaacaaaaccaaagaagaagcagacatcgtcagttgcaaagcaaaaatgtaacacccctacaatggatgccgacaagattgtgttcaaagtcaataaccgggtggtctctttgaagcccgagattatcgtggatcaatatgagtacaagtaccctgctatcaaagatttgaaaaagccttgtataaccctagggaaagcccccgatttaaacaaagcttacaaatcagttttatcaggcatgaatgccgccaaacttgatcctgatgatgtatgctcctacttggcagcagcaatgcagttctttgaggggacatgtccggaagactggaccagctatggaatcctgattgcacgaaaaggagacaagatcaccccagactctctagtggagataaagcgtactgatgtagaagggaattgggctctgacaggaggcatggaactgacaagggaccccactgtctctgaacatgcatctttagtcggtcttctcctgagtctgtacagattgagcaaaatatcaggacaaaacactggtaactataagacaaacattgcggatagaatagagcagattttcgagacagccccttttgttaagatcgtggaacaccacaccctgatgacaactcacaagatgtgtgctaattggagtactataccgaacttcagatttttggccggaacctacgacatgtttttctcacggatcgagcatctgtattcggcaatcagagtgggcacagttgtcaccgcttatgaagactgctcaggactggtatcgtttacagggttcataaagcagatcattctcaccgcaagagaagcaatactatatttcttccacaagaactttgaagaagagataaggagaatgtttgagccagggcaagagacagctgttcctcactcttatttcatccacttccgttcactaggcttgagtgggaagtctccttattcatcaaatgccgtcggtcatgtgttcaatctcattcactttgttggatgctatatgggtcaagtcagatctctaaatgccacggttattgctgcatgtgcccctcatgagatgtctgttctagggggctatttgggagaggagttcttcggaaaagggacatttgaaagaaggttcttcagagacgagaaagaacttcaagaatatgaggcggctgaactgacaaagaccgacgtggcactggcagatgacggaactgtcaactccgatgacgaggactacttctccggtgaaaccagaagtcctgaagctgtctatactcgaatcatgatgaatggaggtcgactgaagagatcacatatacggagatatgtctcagtcagttccaatcatcaagcccgtccaaactcattcgccgaatttttaaacaaaacgtattcgagtgactcataaggagttgaatgacagggtgccagaaatccatagattgtgtatatccatcatgaaaaaaactaacactcctcctttcgaaccatcccaagtatgagcaagatctttgttaatccgagtgcaatcagagccggtctggccgatcttgagatggccgaagagactgttgatctgatcaacagaaacatagaagacaatcaggctcatctccagggagaacccatagaagtggacaatctccctgaggacatgaggcaatttcacctggacgatgaaaaattgtccaaccttggtgagatggttagggtgggcgaaggcaagtatcgagaggactttcagatgaatgagggagaggaccccaacctcctgttccaatcgtacctggacaatgttggagtccaaatagtcagacaaatgaggtcaggagagagattcctcaagatatggtcacagaccgtagaggaaattatatcctatgtctcggtcaactttcctaaccctccaggaaggtcttcggaggataaatcaacccaaactactggccgggagctcaagaaggagacaacatccattctttctcaaagagaaagccaaccttcaaaagccggaatggtggctcaagttgcctctggccctccatcccttgaatggtctgccaccaatggagaggatgatctatcagtagaggctgagatcgctcatcagattgctgaaagcttttccaagaagtacaagtttccttctcgatcttcaggaatattcttgtataattttgagcaactggagatgaaccttgatgacatagttaaagaggcaaaaaatgtaccgggcgtgacccgtctggcccatgatggatccaaaatccccctaagatgtgtactgggatgggtcgctttggccaactccaagaaattccaattgctagtcgaggccgacaagctaagcaaaatcatgcaagatgacttggatcgctacacatcatgctaaccgagtcttcgaattcattccctctagataatgaaaactgagatgtcatggagtcgatatgaaaaaaacaggcaacaccactaataaaatgaactttctatgtaagatagtgaaaaactgtagggatgaggacacccaaaagccctctcccgcgtcagcccctccggatggcgatgacctgtggcttccacctccagaatatgtcccgctgaaagaactcacaagcaagaagaacatgaggaacttttgtatcaacggggaggttaaagtgtgcagtccgaacggttactcattcaggatcctgcggcatattctgagatcattcgacgagatatactctgggaatcataggatgattgggttagtcaaagttgttgttggactagctttatcaggagctccagctcctgagggcatgaactgggtatacaaattgaggagaacccttattttccagtgggctgattccaggggccctcttgaaggggaggagttggaacactctcaagagatcacttgggacgatgatactgaattcgtcggattgcaaatgagagtgagcgcaagacaatgtcatattcaaggcaggatctggtgtatcgacatgaactcgagggcatgtcaactatggtctgacatgtctcttcagacacaaaggtctgaagaggacaaagactcttctctgcttttagaataatcagataatatcccgcaagttcatcacttgtttacttctggaggagagaacatacgggcttaactccaatccttgggagcaatagaacaaaaaaacacgttatgatgccattaaaccgctgcattttatcaaagtcaagttaattaccgttacattttgagcctcttggatgtgaaaaaaactattaacatccctcaaaagacttaaggaaagatggttcctcaggttcttttgtttgcacccctcctggtttctccattgtgtttcgggaagttccccatttacacgataccagacaaacttggtccctggagccctattgacttacaccatctcagctgtccaaataacctggttgtggaggacgaaggatgtaccaacctgtccgggttctcttacatggaacttaaagtgggatacatctcagccataaaagtgaacgggttcacttgcacaggtgttgtgacagaggcagaaacctacaccaactttgttggttatgtcacaaccacattcaagagaaagcatttccgccccaccccagacgcatgtagagccgcgtataactggaagatggccggtgaccccagatatgaagagtctctacacaatccgtaccccgactaccattggcttcgaactgtaaaaaccaccaaagagtctctcgttatcatatccccaagtgtgacagatttggacccatatgacaaatcccttcactcaagggtcttccctggcggaaattgctcaggaataacggtgtcctcgacctactgctcaactaatcatgattacaccatctggatgcctgagaatctgagactagggacatcttgtgacatttttacccatagcagagggaagagagcatccaaaggagacaagacttgcggctttgtggatgaaagaggcctgtataagtctttaaagggagcatgcaaactcaagttatgtggagttctcggacttagacttatggatggaacatgggtcgcgatgcaaacatcagatgagaccaaatggtgccctccaggtcagttggtgaatttgcacgactttcgctcagacgagattgagcatctcgttgaggaagagttagtcaagaaaagagaggagtgtctggatgcactagagtccatcatgaccaccaagtcagtgagtttcagacgtctcagtcacctgagaaaacttgtccctgggtttggaaaagcatataccatattcaacaaaaccttgatggaggctgatgctcactacaagtctgtccagacctggaatgagatcatcccctcaaaagggtgtttgagagttggggagaggtgtcatccccatgtgaacggggtgtttttcaatggtataatattagggtctgacggccatgttctaatcccagagatgcagtcatccctcctccagcaacatatggagttgttggaatcttcagttatccccctgatgcaccccttggcagacccttctacagttttcaaagacggtgatgaggttgaggattttgttgaagttcacctccccgatgtgcataaacaggtctcaggagttgacctgggtctcccgaaatgggggaagtatgtattgatgattgcaggggccttgattgccctgatgttgataattttcctgatgacatgttgcagaagagtcaatcgaccagaatctacacaaagcaatcttggagggacagggagaaatgtgtcagtcccttcccaaagcggaaaagtcatatcttcatgggagtcatataagagtggaggcgagaccagactgtgaaggccggtcatccttttgacacctcaagtccagaggataacctcctcccggggaaaaaaactaacacctctcgtacgaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaactgcagtttgctagcaggaccggtacataactataaagggctgggtcatctaagcatttcagtcgagaaaaaaactgtataccaaaagaacaactaacaacacttctcatctcgagacccatatcaagatgctggatccgggagaggtttatgatgaccctattgatccaattgagtcagaggctgaacccagaggaacccccactgtccccaacatcttgaggaactctgactacaatctcaactctcctttgattgaggactctgccaaactaatgttagaatggttgaaaacagggaacagaccttatcggatgactttgacagacaattgctccaggtcttacaaagatttgaaagattatttcaagaaagtagatttgggttctctcaaagtgggaggaactgctgcacaatcaatgatttctctctggttgtatggagcccactctgagtcaaacaggagccggagatgtataaccgacttggcccatttctattccaagtcatcccccatagagaagctgttgaattgtacgttaggaaacagaggcctgagaatcccaccagagggggtgttaagttgccttgagagggtcgattatgataaggcatttgggaggtatctggccaacacgcattcctcttatctgtttttccatgtaattaccttatacatgaatgccctagactgggaagaggaaaaaaccatcctagcattatggaaagatctaacctcagtggacaccgggaaggacttggtcaaattcaaagatcaaatatggggactgctgattgtgacaaaggactttgtttactctcagagttctaactgtctttttgacagaaactatacactgatgctaaaggatcttttcttgtctcgattcaactccttgatgattttgctttctccccctgagccccgatactcagatgacttaatatctcagctgtgccagctatacatcgctggggatcaagtcttgtccttgtgtgggaactccggctatgaagtcatcaaaatattggagccatatgtcgtgaacagtttggtccagagggcagagaagtttaggcctctcatccactccttgggagactttcctatgtttataaaagacaaggtgaatcaacttgaagggactttcggtcccagtgcaaaaaggttttttagggttctagatcaattcgacaacatacatgatctagtatttgtgtatggctgttacagacattgggggcacccctatatagattatcggaagggtctgttgaaactatatgatcaagttcacattaagaaagtaatagataagtcctaccaggagtgtttagcaagtgacttggctagaaggatcctcagatggggatttgacaagtactccaagtggtatctagattcgagattccttgcccgagaccaccccttggctccttatatcaagacccaaacatggccacccaaacatatagtagacttggtgggggacacatggcacaagctcccgatcacgcagatctttgagattcctgaatcaatggacccgtcagagatactggatgataaatcacattctttcaccagaacaagactagcttcttggctgtcagagaaccgaggggggcctgttcctagcgagaaggtcattatcacggccctgtctcagccacctgtcaatccccgagagtttttgaaatctatcgacctcggaggattgccagatgatgacttgataattggcctcagaccaaaggaacgggagttgaagattgagggccgattcttcgctctaatgtcatggaatctaagattatattttgtcatcaccgagaagctcttggccaactacattttgccactttttgacgcactgactatgacagacaacctgaacaaggtatttaaaaagttgatcgacagggtcaccgggcaagggcttttggactattcgagggtcacttacgcatttcacctggactatgagaaatggaacaatcatcaaagattggagtcaacggaggatgtattttctgtcctagatcaggtgtttggattgaagagggtgttttctagaacacacgagttttttcagaagtcctggatctattattcagacagatcagacctcattgggttacgggaggatcagatatattgcttggatatgtccaatggtccaacctgctggaatggccaagacggcgggctagagggcttacggcagaagggctggagtctagtcagcttattgatgatagatagagaatctcaaaccaggaacacaagaaccaagatactagctcaaggagacaaccaggttctgtgtccgacatacatgttgtcaccgggattgtctcaagaggggcttctctatgagttagagagcatatcgaggaatgcactctcaatataccgagctatcgaggaaggagcatctaaactggggctgatcatcaagaaagaagagaccatgtgtagttatgactttctcatatatgggaagacccccttatttcgaggcaacatattagtacctgaatccaaaagatgggcccgagtctcttgcatctctaacgaccaaatagtcaacctcgccaatataatgtctacagtatccaccaatgcgctgacagtggcacaacactctcaatctctgatcaaacctatgagggattttctgctcatgtcagtacaggcagttttccactacctgctgtttagcccaatcttaaaaggcagggtttataagattctgagtgctgaaggggagagctttctcctagccatgtcgcggataatctatctagatccttctttgggaggggtgtctggaatgtctctcgggaggttccatatacgtcagttctcagaccctgtctctgaagggttgtcattctggagagagatctggttaagctcccacgaatcctggattcacgcgttgtgtcaagaggccgggaaccccgatcttggagagagaacactagagagcttcactcgccttttagaagatcctactaccttaaatatcaaaggaggggccagtcctaccattctactcaaggatgctatcagaaaggctctgtacgacgaggtggacaaggtggaaaattcagagtttcgagaggcaatcctgttgtccaagacccatagagataactttatactctttttaaaatctgttgagcctctgttccctcgatttctcagtgaactcttcagttcgtccttcttgggaataccagagtcaattattggactgatacaaaactccaggacaataagaaggcagtttagaaagagtctctcaagaactttagaagagtccttctacaactcagagatccacgggattaatcggatgacccagacacctcaaagggtcgggagagtgtggccctgctcttcagagagggcagatctacttagggagatctcttggggaaggaaagtggtgggcacgacagttcctcacccttccgagatgttggggctgcttccaaaatcctctatttcctgcacttgtggagcaacagggggaggcaatcctagagtttctgtatcagtactcccgtccttcgatcagtcatttttttcacgaggtcctctaaagggatacttgggctcgtccacctccatgtcaacccagctattccatgcatgggaaaaagtcactaatgttcatgtggtgaaaagggctatatcgttaaaagaatctataaactggttcatcaatagaaattccaatttggctcaaactctaattagaaacatcatgtctctgacaggccctgatttctctctagaagaggctcctgttttcaaacggacagggtcagccttgcataggttcaagtctgccagatacagcgaaggagggtattcttctgtttgtcctaaccttctctctcatatctctgtcagtacagacactatgtctgatttgacccaagacgggaagaactatgatttcatgtttcagccattgatgctttatgcgcaaacatggacatcagagctggtacagagagacacaagactgagagactccacgtttcactggcaccttcgatgcaacagatgtgtaaggcccattgaggatataacactggaaacttctcagatcttcgagttcccggatgtgtcaaaaaggatatccaggatggtttctggagccgtccctcactttcagaagcttcctgatatccgtctaagaccaggtgattttgaatctctaagtggtagagaaaagtctcgccacatagggtcagctcaggggctcttatactcaatcttagtagcaattcacgattcaggatacaatgatgggaccatcttccctgtcaacatatacggcaaggtttcccctagagactatttgagagggctcgcaagagggatcttgataggatcctcgatttgcttcttgacacgaatgacaaatattaatattaaaagacctcttgaattgatctcaggggtaatttcctatattctcctgaggctggataatcatccctctctgtatataatgcttagagaaccgtctcttagaggagagatattctctatccctcagaagatccccgccgcttacccaaccactatgaaagaaggcaacagatcgatcttgtgttacctccaacacgtgctacgctatgagcgagaagtaatcacggcgtccccggagaatgactggctgtggatcttctcagacttcagaagtgcgaaaatgacgtacttgaccctcattacctaccagtctcacctcctactccagagggttgagcgaaacttgtctaagagtatgagagctactctgcaacaaatgggttccttaatgaggcaagtgctgggtgggcacggagaagacaccttggagtcagacgacgacattcaacgattactaaaagactctttgcgaaggacgaggtgggtagatcaagaggtgcgccatgcagctagaaccatgagtggagattacagccccaacaagagagtatctcgcaaggcaggatgttcagaatgggtctgctctgctcaacaggttgccgtctccacctcagccaacccggcccctgtctcagagcttgacattagggccctatctaagaggtttcaaaaccccttgatctcgggcctaagagtggttcagtgggcaaccggcgcccattataagctaaagcctattctagatgatctaaatgttttcccatctctctgtcttgttgttggagacgggtcagggggaatatcaagggcagttctcaacatgtttccagattctaagcttgtgttcaacagcctattggaggtgaatgatctgatggcttccggaacacgtccactgcctccttcagcaatcatgagtggaggagatgatatcatctccagagtgatagactttgactcaatctgggaaaaaccatccgacctgaggaacttggccacctggagatacttccagtcagttcaaaagcaggtcaacatgtcgtatgacctcattatttgtgatgcagaagttactgatattgcatctatcaaccggataactctgttgatgtctgatttcgcattgtctatagatggaccactttatctggtcttcaaaacttacgggactatgctagtgaacccagactataaagctatccaacatctgtcaagagcgttcccttcggtcacagggtttataacccaagtaacttcgtccttttcttctgagctgtacctccggttctccaaacgagggaagttttttagggatgctgagtacttgacctcttccacccttcgggagatgagccttgtgttattcaattgtagcagccccaaaagtgagatgcagagagctcgttccttaaactatcaagatcttgtaaggggatttcctgaagagatcatatcaaatccttacaatgaaatgatcataactctgattgacagtgatgtagagtccttcctggtccacaagatggtggatgatcttgagttacagaggggaactctgtctaaagtggctatcattatatccatcatgatcgttttttccaacagagtcttcaacatttccaaacctttgactgaccccttgttctatcccccatctgatcctaaaatcctgaggcacttcaacatatgttgcagtactatgatgtatctatctaccgctttaggcgacgtccctagcttcgcaagacttcatgacctatataatagacctataacttattacttcagaaagcaagttattcgagggaatatctatctatcttggagctggtccgatgacaccccagtgttcaagagggtagcctgtaattctagcttgagtctgtcatctcactggatcaggttgatttacaagatagtgaagactaccagactcgttggccgcatagaagatctatcaggagaggtagaacgacacctgcatgggtacaacagatggatcaccctcgaggatatccgatctagatcatccctactagactacagttgtttgtaagccggacattaatgaaagcctgtacatgctaaaattcttgtatgatgcatcttgaaaaaaacaagatcttgaatcagaacctctggttgtttgattgttttttttatctttattgtttatttgttaagcgtgggtcggcatggcatctccacctcctcgcggtccgacctgggcatccgaaggaggacgcacgtccactcggatggctaagggagggcgggtaccacgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgctgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagtgttaagcgtctgatgagtccgtgaggacgaaactataggaaaggaattcctatagtc

SEQ ID NO: 53 - DNA, 16992 bp, Artificial Sequence
  pHEP-pMag-nMaghigh
acgcttaacaacaaaaccaaagaagaagcagacatcgtcagttgcaaagcaaaaatgtaacacccctacaatggatgccgacaagattgtgttcaaagtcaataaccgggtggtctctttgaagcccgagattatcgtggatcaatatgagtacaagtaccctgctatcaaagatttgaaaaagccttgtataaccctagggaaagcccccgatttaaacaaagcttacaaatcagttttatcaggcatgaatgccgccaaacttgatcctgatgatgtatgctcctacttggcagcagcaatgcagttctttgaggggacatgtccggaagactggaccagctatggaatcctgattgcacgaaaaggagacaagatcaccccagactctctagtggagataaagcgtactgatgtagaagggaattgggctctgacaggaggcatggaactgacaagggaccccactgtctctgaacatgcatctttagtcggtcttctcctgagtctgtacagattgagcaaaatatcaggacaaaacactggtaactataagacaaacattgcggatagaatagagcagattttcgagacagccccttttgttaagatcgtggaacaccacaccctgatgacaactcacaagatgtgtgctaattggagtactataccgaacttcagatttttggccggaacctacgacatgtttttctcacggatcgagcatctgtattcggcaatcagagtgggcacagttgtcaccgcttatgaagactgctcaggactggtatcgtttacagggttcataaagcagatcattctcaccgcaagagaagcaatactatatttcttccacaagaactttgaagaagagataaggagaatgtttgagccagggcaagagacagctgttcctcactcttatttcatccacttccgttcactaggcttgagtgggaagtctccttattcatcaaatgccgtcggtcatgtgttcaatctcattcactttgttggatgctatatgggtcaagtcagatctctaaatgccacggttattgctgcatgtgcccctcatgagatgtctgttctagggggctatttgggagaggagttcttcggaaaagggacatttgaaagaaggttcttcagagacgagaaagaacttcaagaatatgaggcggctgaactgacaaagaccgacgtggcactggcagatgacggaactgtcaactccgatgacgaggactacttctccggtgaaaccagaagtcctgaagctgtctatactcgaatcatgatgaatggaggtcgactgaagagatcacatatacggagatatgtctcagtcagttccaatcatcaagcccgtccaaactcattcgccgaatttttaaacaaaacgtattcgagtgactcataaggagttgaatgacagggtgccagaaatccatagattgtgtatatccatcatgaaaaaaactaacactcctcctttcgaaccatcccaagtatgagcaagatctttgttaatccgagtgcaatcagagccggtctggccgatcttgagatggccgaagagactgttgatctgatcaacagaaacatagaagacaatcaggctcatctccagggagaacccatagaagtggacaatctccctgaggacatgaggcaatttcacctggacgatgaaaaattgtccaaccttggtgagatggttagggtgggcgaaggcaagtatcgagaggactttcagatgaatgagggagaggaccccaacctcctgttccaatcgtacctggacaatgttggagtccaaatagtcagacaaatgaggtcaggagagagattcctcaagatatggtcacagaccgtagaggaaattatatcctatgtctcggtcaactttcctaaccctccaggaaggtcttcggaggataaatcaacccaaactactggccgggagctcaagaaggagacaacatccattctttctcaaagagaaagccaaccttcaaaagccggaatggtggctcaagttgcctctggccctccatcccttgaatggtctgccaccaatggagaggatgatctatcagtagaggctgagatcgctcatcagattgctgaaagcttttccaagaagtacaagtttccttctcgatcttcaggaatattcttgtataattttgagcaactggagatgaaccttgatgacatagttaaagaggcaaaaaatgtaccgggcgtgacccgtctggcccatgatggatccaaaatccccctaagatgtgtactgggatgggtcgctttggccaactccaagaaattccaattgctagtcgaggccgacaagctaagcaaaatcatgcaagatgacttggatcgctacacatcatgctaaccgagtcttcgaattcattccctctagataatgaaaactgagatgtcatggagtcgatatgaaaaaaacaggcaacaccactaataaaatgaactttctatgtaagatagtgaaaaactgtagggatgaggacacccaaaagccctctcccgcgtcagcccctccggatggcgatgacctgtggcttccacctccagaatatgtcccgctgaaagaactcacaagcaagaagaacatgaggaacttttgtatcaacggggaggttaaagtgtgcagtccgaacggttactcattcaggatcctgcggcatattctgagatcattcgacgagatatactctgggaatcataggatgattgggttagtcaaagttgttgttggactagctttatcaggagctccagctcctgagggcatgaactgggtatacaaattgaggagaacccttattttccagtgggctgattccaggggccctcttgaaggggaggagttggaacactctcaagagatcacttgggacgatgatactgaattcgtcggattgcaaatgagagtgagcgcaagacaatgtcatattcaaggcaggatctggtgtatcgacatgaactcgagggcatgtcaactatggtctgacatgtctcttcagacacaaaggtctgaagaggacaaagactcttctctgcttttagaataatcagataatatcccgcaagttcatcacttgtttacttctggaggagagaacatacgggcttaactccaatccttgggagcaatagaacaaaaaaacacgttatgatgccattaaaccgctgcattttatcaaagtcaagttaattaccgttacattttgagcctcttggatgtgaaaaaaactattaacatccctcaaaagacttaaggaaagatggttcctcaggttcttttgtttgcacccctcctggtttctccattgtgtttcgggaagttccccatttacacgataccagacaaacttggtccctggagccctattgacttacaccatctcagctgtccaaataacctggttgtggaggacgaaggatgtaccaacctgtccgggttctcttacatggaacttaaagtgggatacatctcagccataaaagtgaacgggttcacttgcacaggtgttgtgacagaggcagaaacctacaccaactttgttggttatgtcacaaccacattcaagagaaagcatttccgccccaccccagacgcatgtagagccgcgtataactggaagatggccggtgaccccagatatgaagagtctctacacaatccgtaccccgactaccattggcttcgaactgtaaaaaccaccaaagagtctctcgttatcatatccccaagtgtgacagatttggacccatatgacaaatcccttcactcaagggtcttccctggcggaaattgctcaggaataacggtgtcctcgacctactgctcaactaatcatgattacaccatctggatgcctgagaatctgagactagggacatcttgtgacatttttacccatagcagagggaagagagcatccaaaggagacaagacttgcggctttgtggatgaaagaggcctgtataagtctttaaagggagcatgcaaactcaagttatgtggagttctcggacttagacttatggatggaacatgggtcgcgatgcaaacatcagatgagaccaaatggtgccctccaggtcagttggtgaatttgcacgactttcgctcagacgagattgagcatctcgttgaggaagagttagtcaagaaaagagaggagtgtctggatgcactagagtccatcatgaccaccaagtcagtgagtttcagacgtctcagtcacctgagaaaacttgtccctgggtttggaaaagcatataccatattcaacaaaaccttgatggaggctgatgctcactacaagtctgtccagacctggaatgagatcatcccctcaaaagggtgtttgagagttggggagaggtgtcatccccatgtgaacggggtgtttttcaatggtataatattagggtctgacggccatgttctaatcccagagatgcagtcatccctcctccagcaacatatggagttgttggaatcttcagttatccccctgatgcaccccttggcagacccttctacagttttcaaagacggtgatgaggttgaggattttgttgaagttcacctccccgatgtgcataaacaggtctcaggagttgacctgggtctcccgaaatgggggaagtatgtattgatgattgcaggggccttgattgccctgatgttgataattttcctgatgacatgttgcagaagagtcaatcgaccagaatctacacaaagcaatcttggagggacagggagaaatgtgtcagtcccttcccaaagcggaaaagtcatatcttcatgggagtcatataagagtggaggcgagaccagactgtgaaggccggtcatccttttgacacctcaagtccagaggataacctcctcccggggaaaaaaactaacacctctcgtacgaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaactgcagtttgctagcaggaccggtacataactataaagggctgggtcatctaagcatttcagtcgagaaaaaaactgtataccaaaagaacaactaacaacacttctcatctcgagacccatatcaagatgctggatccgggagaggtttatgatgaccctattgatccaattgagtcagaggctgaacccagaggaacccccactgtccccaacatcttgaggaactctgactacaatctcaactctcctttgattgaggactctgccaaactaatgttagaatggttgaaaacagggaacagaccttatcggatgactttgacagacaattgctccaggtcttacaaagatttgaaagattatttcaagaaagtagatttgggttctctcaaagtgggaggaactgctgcacaatcaatgatttctctctggttgtatggagcccactctgagtcaaacaggagccggagatgtataaccgacttggcccatttctattccaagtcatcccccatagagaagctgttgaattgtacgttaggaaacagaggcctgagaatcccaccagagggggtgttaagttgccttgagagggtcgattatgataaggcatttgggaggtatctggccaacacgcattcctcttatctgtttttccatgtaattaccttatacatgaatgccctagactgggaagaggaaaaaaccatcctagcattatggaaagatctaacctcagtggacaccgggaaggacttggtcaaattcaaagatcaaatatggggactgctgattgtgacaaaggactttgtttactctcagagttctaactgtctttttgacagaaactatacactgatgctaaaggatcttttcttgtctcgattcaactccttgatgattttgctttctccccctgagccccgatactcagatgacttaatatctcagctgtgccagctatacatcgctggggatcaagtcttgtccttgtgtgggaactccggctatgaagtcatcaaaatattggagccatatgtcgtgaacagtttggtccagagggcagagaagtttaggcctctcatccactccttgggagactttcctatgtttataaaagacaaggtgaatcaacttgaagggactttcggtcccagtgcaaaaaggttttttagggttctagatcaattcgacaacatacatgatctagtatttgtgtatggctgttacagacattgggggcacccctatatagattatcggaagggtctgttgaaactatatgatcaagttcacattaagaaagtaatagataagtcctaccaggagtgtttagcaagtgacttggctagaaggatcctcagatggggatttgacaagtactccaagtggtatctagattcgagattccttgcccgagaccaccccttggctccttatatcaagacccaaacatggccacccaaacatatagtagacttggtgggggacacatggcacaagctcccgatcacgcagatctttgagattcctgaatcaatggacccgtcagagatactggatgataaatcacattctttcaccagaacaagactagcttcttggctgtcagagaaccgaggggggcctgttcctagcgagaaggtcattatcacggccctgtctcagccacctgtcaatccccgagagtttttgaaatctatcgacctcggaggattgccagatgatgacttgataattggcctcagaccaaaggaacgggagttgaagattgagggccgattcttcgctctaatgtcatggaatctaagattatattttgtcatcaccgagaagctcttggccaactacattttgccactttttgacgcactgactatgacagacaacctgaacaaggtatttaaaaagttgatcgacagggtcaccgggcaagggcttttggactattcgagggtcacttacgcatttcacctggactatgagaaatggaacaatcatcaaagattggagtcaacggaggatgtattttctgtcctagatcaggtgtttggattgaagagggtgttttctagaacacacgagttttttcagaagtcctggatctattattcagacagatcagacctcattgggttacgggaggatcagatatattgcttggatatgtccaatggtccaacctgctggaatggccaagacggcgggctagagggcttacggcagaagggctggagtctagtcagcttattgatgatagatagagaatctcaaaccaggaacacaagaaccaagatactagctcaaggagacaaccaggttctgtgtccgacatacatgttgtcaccgggattgtctcaagaggggcttctctatgagttagagagcatatcgaggaatgcactctcaatataccgagctatcgaggaaggagcatctaaactggggctgatcatcaagaaagaagagaccatgtgtagttatgactttctcatatatgggaagacccccttatttcgaggcaacatattagtacctgaatccaaaagatgggcccgagtctcttgcatctctaacgaccaaatagtcaacctcgccaatataatgtctacagtatccaccaatgcgctgacagtggcacaacactctcaatctctgatcaaacctatgagggattttctgctcatgtcagtacaggcagttttccactacctgctgtttagcccaatcttaaaaggcagggtttataagattctgagtgctgaaggggagagctttctcctagccatgtcgcggataatctatctagatccttctttgggaggggtgtctggaatgtctctcgggaggttccatatacgtcagttctcagaccctgtctctgaagggttgtcattctggagagagatctggttaagctcccacgaatcctggattcacgcgttgtgtcaagaggccgggaaccccgatcttggagagagaacactagagagcttcactcgccttttagaagatcctactaccttaaatatcaaaggaggggccagtcctaccattctactcaaggatgctatcagaaaggctctgtacgacgaggtggacaaggtggaaaattcagagtttcgagaggcaatcctgttgtccaagacccatagagataactttatactctttttaaaatctgttgagcctctgttccctcgatttctcagtgaactcttcagttcgtccttcttgggaataccagagtcaattattggactgatacaaaactccaggacaataagaaggcagtttagaaagagtctctcaagaactttagaagagtccttctacaactcagagatccacgggattaatcggatgacccagacacctcaaagggtcgggagagtgtggccctgctcttcagagagggcagatctacttagggagatctcttggggaaggaaagtggtgggcacgacagttcctcacccttccgagatgttggggctgcttccaaaatcctctatttcctgcacttgtggagcaacagggggaggcaatcctagagtttctgtatcagtactcccgtccttcgatcagtcatttttttcacgaggtcctctaaagggatacttgggctcgtccacctccatgtcaacccagctattccatgcatgggaaaaagtcactaatgttcatgtggtgaaaagggctatatcgttaaaagaatctataaactggttcatcaatagaaattccaatttggctcaaactctaattagaaacatcatgtctctgacaggccctgatttctctctagaagaggctcctgttttcaaacggacagggtcagccttgcataggttcaagtctgccagatacagcgaaggagggtattcttctgtttgtcctaaccttctctctcatatctctgtcagtacagacactatgtctgatttgacccaagacgggaagaactatgatttcatgtttcagccattgatgctttatgcgcaaacatggacatcagagctggtacagagagacacaagactgagagactccacgtttcactggcaccttcgatgcaacagatgtgtaaggcccattgaggatataacactggaaacttctcagatcttcgagttcccggatgtgtcaaaaaggatatccaggatggtttctggagccgtccctcactttcagaagcttcctgatatccgtctaagaccaggtgattttgaatctctaagtggtagagaaaagtctcgccacatagggtcagctcaggggctcttatactcaatcttagtagcaattcacgattcaggatacaatgatgggaccatcttccctgtcaacatatacggcaaggtttcccctagagactatttgagagggctcgcaagagggatcttgataggatcctcgatttgcttcttgacacgaatgacaaatattaatattaaaagacctcttgaattgatctcaggggtaatttcctatattctcctgaggctggataatcatccctctctgtatataatgcttagagaaccgtctcttagaggagagatattctctatccctcagaagatccccgccgcttacccaaccactatgaaagaaggcaacagatcgatcttgtgttacctccaacacgtgctacgctatgagcgagaagtaatcacggcgtccccggagaatgactggctgtggatcttctcagacttcagaagtgcgaaaatgacgtacttgaccctcattacctaccagtctcacctcctactccagagggttgagcgaaacttgtctaagagtatgagagctactctgcaacaaatgggttccttaatgaggcaagtgctgggtgggcacggagaagacaccttggagtcagacgacgacattcaacgattactaaaagactctttgcgaaggacgaggtgggtagatcaagaggtgcgccatgcagctagaaccatgagtggagattacagccccaacaagcttaagagccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaaaccggtaattccgctgacggcggcggaggatcgggtggtagtggtggttcaggaggaggatcgacccaaggaggatccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatccgcaaggcaatcgacaggaatgccgaggtgcaggttgaagtagtcaattttaaaaagaatggacagcgatttgttaatttcctgactatcatacctgttagggacgaaacaggcgagtatcgatactctatgggattccagtgcgaaacagaatatccgtacgacgtcccagattacgcgggccttaaggtatctcgcaaggcaggatgttcagaatgggtctgctctgctcaacaggttgccgtctccacctcagccaacccggcccctgtctcagagcttgacattagggccctatctaagaggtttcaaaaccccttgatctcgggcctaagagtggttcagtgggcaaccggcgcccattataagctaaagcctattctagatgatctaaatgttttcccatctctctgtcttgttgttggagacgggtcagggggaatatcaagggcagttctcaacatgtttccagattctaagcttgtgttcaacagcctattggaggtgaatgatctgatggcttccggaacacgtccactgcctccttcagcaatcatgagtggaggagatgatatcatctccagagtgatagactttgactcaatctgggaaaaaccatccgacctgaggaacttggccacctggagatacttccagtcagttcaaaagcaggtcaacatgtcgtatgacctcattatttgtgatgcagaagttactgatattgcatctatcaaccggataactctgttgatgtctgatttcgcattgtctatagatggaccactttatctggtcttcaaaacttacgggactatgctagtgaacccagactataaagctatccaacatctgtcaagagcgttcccttcggtcacagggtttataacccaagtaacttcgtccttttcttctgagctgtacctccggttctccaaacgagggaagttttttagggatgctgagtacttgacctcttccacccttcgggagatgagccttgtgttattcaattgtagcagccccaaaagtgagatgcagagagctcgttccttaaactatcaagatcttgtaaggggatttcctgaagagatcatatcaaatccttacaatgaaatgatcataactctgattgacagtgatgtagagtccttcctggtccacaagatggtggatgatcttgagttacagaggggaactctgtctaaagtggctatcattatatccatcatgatcgttttttccaacagagtcttcaacatttccaaacctttgactgaccccttgttctatcccccatctgatcctaaaatcctgaggcacttcaacatatgttgcagtactatgatgtatctatctaccgctttaggcgacgtccctagcttcgcaagacttcatgacctatataatagacctataacttattacttcagaaagcaagttattcgagggaatatctatctatcttggagctggtccgatgacaccccagtgttcaagagggtagcctgtaattctagcttgagtctgtcatctcactggatcaggttgatttacaagatagtgaagactaccagactcgttggccgcatagaagatctatcaggagaggtagaacgacacctgcatgggtacaacagatggatcaccctcgaggatatccgatctagatcatccctactagactacagttgtttgtaagccggacattaatgaaagcctgtacatgctaaaattcttgtatgatgcatcttgaaaaaaacaagatcttgaatcagaacctctggttgtttgattgttttttttatctttattgtttatttgttaagcgtgggtcggcatggcatctccacctcctcgcggtccgacctgggcatccgaaggaggacgcacgtccactcggatggctaagggagggcgggtaccacgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgctgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagtgttaagcgtctgatgagtccgtgaggacgaaactataggaaaggaattcctatagtc

SEQ ID NO: 54 - DNA, 23 bp, Artificial Sequence
  Forward1 Primer
tgttacctccaacacgtgctacg

SEQ ID NO: 55 - DNA, 35 bp, Artificial Sequence
  Forward2 Primer
caacaagcttaagagccatactctttatgcccccg

SEQ ID NO: 56 - DNA, 30 bp, Artificial Sequence
  Forward3 Primer
cgggccttaaggtatctcgcaaggcaggat

SEQ ID NO: 57 - DNA, 28 bp, Artificial Sequence
  Reverse1 Primer
ctcttaagcttgttggggctgtaatctc

SEQ ID NO: 58 - DNA, 28 bp, Artificial Sequence
  Reverse2 Primer
ataccttaaggcccgcgtaatctgggac

SEQ ID NO: 59 - DNA, 17 bp, Artificial Sequence
  Reverse3 Primer
atgcccaggtcggaccg

SEQ ID NO: 60 - DNA, 6355 bp, Artificial Sequence
  pH-N
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcacaatggatgccgacaagattgtgttcaaagtcaataaccgggtggtctctttgaagcccgagattatcgtggatcaatatgagtacaagtaccctgctatcaaagatttgaaaaagccttgtataaccctagggaaagcccccgatttaaacaaagcttacaaatcagttttatcaggcatgaatgccgccaaacttgatcctgatgatgtatgctcctacttggcagcagcaatgcagttctttgaggggacatgtccggaagactggaccagctatggaatcctgattgcacgaaaaggagacaagatcaccccagactctctagtggagataaagcgtactgatgtagaagggaattgggctctgacaggaggcatggaactgacaagggaccccactgtctctgaacatgcatctttagtcggtcttctcctgagtctgtacagattgagcaaaatatcaggacaaaacactggtaactataagacaaacattgcggatagaatagagcagattttcgagacagccccttttgttaagatcgtggaacaccacaccctgatgacaactcacaagatgtgtgctaattggagtactataccgaacttcagatttttggccggaacctacgacatgtttttctcacggatcgagcatctgtattcggcaatcagagtgggcacagttgtcaccgcttatgaagactgctcaggactggtatcgtttacagggttcataaagcagatcaatctcaccgcaagagaagcaatactatatttcttccacaagaactttgaagaagagataaggagaatgtttgagccagggcaagagacagctgttcctcactcttatttcattcacttccgttcactaggcttgagtgggaagtctccttattcatcaaatgccgtcggtcatgtgttcaatctcattcactttgttggatgctatatgggtcaagtcagatctctaaatgccacggttattgctgcatgtgcccctcatgagatgtctgttctagggggctatttgggagaggagttcttcggaaaagggacatttgaaagaaggttcttcagagacgagaaagaacttcaagaatatgaggcggctgaactgacaaagaccgacgtggcactggcagatgacggaactgtcaactccgatgacgaggactacttctccggtgaaaccagaagtcctgaagctgtctatactcgaatcatgatgaatggaggtcgactgaagagatcacatatacggagatatgtctcagtcagttccaatcatcaagcccgtccaaactcattcgccgaatttttaaacaaaacgtattcgagtgactcataaggtaccgagctcggatccactagtccagtgtggtggaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 61 - DNA, 5899 bp, Artificial Sequence
  pH-P
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttggtaccatcccaagtatgagcaagatctttgttaatccgagtgcaatcagagccggtctggccgatcttgagatggccgaagagactgttgatctgatcaacagaaacatagaagacaatcaggctcatctccagggagaacccatagaagtggacaatctccctgaggacatgaggcaatttcacctggacgatgaaaaattgtccaaccttggtgagatggttagggtgggcgaaggcaagtatcgagaggactttcagatgaatgagggagaggaccccaacctcctgttccaatcgtacctggacaatgttggagtccaaatagtcagacaaatgaggtcaggagagagattcctcaagatatggtcacagaccgtagaggaaattatatcctatgtctcggtcaactttcctaaccctccaggaaggtcttcggaggataaatcaacccaaactactggccgggagctcaagaaggagacaacatccattctttctcaaagagaaagccaaccttcaaaagccggaatggtggctcaagttgcctctggccctccatcccttgaatggtctgccaccaatggagaggatgatctatcagtagaggctgagatcgctcatcagattgctgaaagcttttccaagaagtacaagtttccttctcgatcttcaggaatattcttgtataattttgagcaactggagatgaaccttgatgacatagttaaagaggcaaaaaatgtaccgggcgtgacccgtctggcccatgatggatccaaaatccccctaagatgtgtactgggatgggtcgctttggccaactccaagaaattccaattgctagtcgaggccgacaagctaagcaaaatcatgcaagatgacttggatcgctacacatcatgctaaccgagtcttcgaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 62 - DNA, 11373 bp, Artificial Sequence
  pH-L
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcaagatgctggatccgggagaggtttatgatgaccctattgatccaattgagtcagaggctgaacccagaggaacccccactgtccccaacatcttgaggaactctgactacaatctcaactctcctttgattgaggactctgccaaactaatgttagaatggttgaaaacagggaacagaccttatcggatgactttgacagacaattgctccaggtcttacaaagatttgaaagattatttcaagaaagtagatttgggttctctcaaagtgggaggaactgctgcacaatcaatgatttctctctggttgtatggagcccactctgagtcaaacaggagccggagatgtataaccgacttggcccatttctattccaagtcatcccccatagagaagctgttgaattgtacgttaggaaacagaggcctgagaatcccaccagagggggtgttaagttgccttgagagggtcgattatgataaggcatttgggaggtatctggccaacacgtattcctcttatctgtttttccatgtaattaccttatacatgaatgccctagactgggaagaggaaaaaaccatcctagcattatggaaagatctaacctcagtggacaccgggaaggacttggtcaaattcaaagatcaaatatggggactgctgattgtgacaaaggactttgtttactctcagagttctaactgtctttttgacagaaactatacactgatgctaaaggatcttttcttgtctcgattcaactccttgatgattttgctttctccccctgagccccgatactcagatgacttaatatctcagctgtgccagctatacatcgctggggatcaagtcttgtccttgtgtgggaactccggctatgaagtcatcaaaatattggagccatatgtcgtgaacagtttggtccagagggcagagaagtttaggcctctcatccactccttgggagactttcctatgtttataaaagacaaggtgaatcaacttgaagggactttcggtcccagtgcaaaaaggttttttagggttctagatcaattcgacaacatacatgatctagtatttgtgtatggctgttacagacattgggggcacccctatatagattatcggaagggtctgttgaaactatatgatcaagttcacattaagaaagtaatagataagtcctaccaggagtgtttagcaagtgacttggctagaaggatcctcagatggggatttgacaagtactccaagtggtatctagattcgagattccttgcccgagaccaccccttggctccttatatcaagacccaaacatggccacccaaacatatagtagacttggtgggggacacatggcacaagctcccgatcacgcagatctttgagattcctgaatcaatggacccgtcagagatactggatgataaatcacattctttcaccagaacaagactagcttcttggctgtcagagaaccgaggggggcctgttcctagcgagaaggtcattatcacggccctgtctcagccacctgtcaatccccgagagtttttgaaatctatcgacctcggaggattgccagatgatgacttgataattggcctcagaccaaaggaacgggagttgaagattgagggccgattcttcgctctaatgtcatggaatctaagattatattttgtcatcaccgagaagctcttggccaactacattttgccactttttgacgcactgactatgacagacaacctgaacaaggtatttaaaaagttgatcgacagggtcaccgggcaagggcttttggactattcgagggtcacttacgcatttcacctggactatgagaaatggaacaatcatcaaagattggagtcaacggaggatgtattttctgtcctagatcaggtgtttggattgaagagggtgttttctagaacacacgagttttttcagaagtcctggatctattattcagacagatcagacctcattgggttacgggaggatcagatatattgcttggatatgtccaatggtccaacctgctggaatggccaagacggcgggctagagggcttacggcagaagggctggagtctagtcagcttattgatgatagatagagaatctcaaaccaggaacacaagaaccaagatactagctcaaggagacaaccaggttctgtgtccgacatacatgttgtcaccgggattgtctcaagaggggcttctctatgagttagagagcatatcgaggaatgcactctcaatataccgagctatcgaggaaggagcatctaaactggggctgatcatcaagaaagaagagaccatgtgtagttatgactttctcatatatgggaagacccccttatttcgaggcaacatattagtacctgaatccaaaagatgggcccgagtctcttgcatctctaacgaccaaatagtcaacctcgccaatataatgtcgacagtgtccaccaatgcgctgacagtggcacaacactctcaatctctgatcaaacctatgagggattttctgctcatgtcagtacaggcagttttccactacctgctgtttagcccaatcttaaaaggcagggtttacaagattctgagtgctgaaggggagagctttctcctagccatgtcgcggataatctatctagatccttctttgggaggggtgtctggaatgtctctcgggaggttccatatacgtcagttctcagaccctgtctctgaagggttgtcattctggagagagatctggttaagctcccacgaatcctggattcacgcgttgtgtcaagaggccgggaaccccgatcttggagagagaacactagagagcttcactcgccttttagaagatcctactaccttaaatatcaaaggaggggctagtcctaccattctactcaaggatgctatcagaaaggctctgtacgacgaggtggacaaggtggaaaattcagagtttcgagaggcaatcctgttgtccaagacccatagagataactttatactctttttaaaatctgttgagcctctgttccctcgatttctcagtgaactcttcagttcgtccttcttgggaataccagagtcaattattggactgatacaaaactccaggacaataagaaggcagtttagaaagagtctctcaagaactttagaagagtccttctacaactcagagatccacgggattaatcggatgacccagacacctcaaagggtcgggagagtgtggccctgctcttcagagagggcagatctacttagggagatctcttggggaaggaaagtggtgggcacgacagttcctcacccttccgagatgttggggctgcttccaaaatcctctatttcctgcacttgtggagcaacagggggaggcaatcctagagtttctgtatcagtactcccgtccttcgatcagtcatttttttcacgaggtcctctaaagggatacttgggctcgtccacctccatgtcaacccagctattccatgcatgggaaaaagtcactaatgttcatgtggtgaaaagggctatatcgttaaaagaatctataaactggttcatcaatagaaattccaatttggctcaaactctaattagaaacatcatgtctctgacaggccctgatttctctctagaagaggctcctgttttcaaacggacagggtcagccttgcataggttcaagtctgccagatacagcgaaggagggtattcttctgtttgtcctaaccttctctctcatatctctgtcagtacagacactatgtctgatttgacccaagacgggaagaactatgatttcatgtttcagccattgatgctttatgcgcaaacatggacatcagagctggtacagagagacacaagactgagagactccacgtttcactggcaccttcgatgcaacagatgtgtaaggcccattgaggatataacactggaaacttctcagatcttcgagttcccggatgtgtcaaaaaggatatccaggatggtttctggagccgtccctcactttcagaagcttcctgatatccgtctaagaccaggtgattttgaatctctaagtggtagagaaaagtctcgccacatagggtcagctcaggggctcttatactcaatcttagtagcaattcacgattcaggatacaatgatgggaccatcttccctgtcaacatatacggcaaggtttcccctagagactatttgagagggctcgcaagagggatcttgataggatcctcgatttgcttcttgacacgaatgacaaatattaatattaaaagacctcttgaattgatctcaggggtaatttcctatattctcctgaggctggataatcatccctctctgtatataatgcttagagaaccgtctcttagaggagagatattctctatccctcagaagatccccgccgcttacccaaccactatgaaagaaggcaacagatcgatcttgtgttacctccaacacgtgctacgctatgagcgagaagtaatcacggcgtccccggagaatgactggctgtggatcttctcagacttcagaagtgcgaaaatgacgtacttgaccctcattacctaccagtctcacctcctactccagagggttgagcgaaacttgtctaagagtatgagagctactctgcaacaaatgggttccttaatgaggcaagtgctgggtgggcacggagaagacaccttggagtcagacgacgacattcaacgattactaaaagactctttgcgaaggacgaggtgggtagatcaagaggtgcgccatgcagctagaaccatgagtggagattacagccccaacaagagagtatctcgcaaggcaggatgttcagaatgggtctgctctgctcaacaggttgccgtctccacctcagccaacccggcccctgtctcagagcttgacattagggccctatctaagaggtttcaaaaccccttgatctcgggcctaagagtggttcagtgggcaaccggcgcccattataagcttaagcctattctagatgatctaaatgttttcccatctctctgtcttgttgttggagacgggtcagggggaatatcaagggcagttctcaacatgtttccagattctaagcttgtgttcaacagcctattggaggtgaatgatctgatggcttccggaacacgtccactgcctccttcagcaatcatgagtggaggagatgatatcatctccagagtgatagactttgactcaatctgggaaaaaccatccgacctgaggaacttggccacctggagatacttccagtcagttcaaaagcaggtcaacatgtcgtatgacctcattatttgtgatgcagaagttactgatattgcatctatcaaccggataactctgttgatgtctgatttcgcattgtctatagatggaccactttatctggtcttcaaaacttacgggactatgctagtgaacccagactataaagctatccaacatctgtcaagagcgttcccttcggtcacagggtttataacccaagtaacttcgtccttttcttctgagctgtacctccggttctccaaacgagggaagttttttagggatgctgagtacttgacctcttccacccttcgggagatgagccttgtgttattcaattgtagcagccccaaaagtgagatgcagagagctcgttccttaaactatcaagatcttgtaaggggatttcctgaagagatcatatcaaatccttacaatgaaatgatcataactctgattgacagtgatgtagagtccttcctggtccacaagatggtggatgatcttgagttacagaggggaactctgtctaaagtggctatcattatatccatcatgatcgttttttccaacagagtcttcaacatttccaaacctttgactgaccccttgttctatcccccatctgatcctaaaatcctgaggcacttcaacatatgttgcagtactatgatgtatctatctaccgctttaggcgacgtccctagcttcgcaagacttcatgacctatataatagacctataacttattacttcagaaagcaagttattcgagggaatatctatctatcttggagctggtccgatgacaccccagtgttcaagagggtagcctgtaattctagcttgagtctgtcatctcactggatcaggttgatttacaagatagtgaagactaccagactcgttggccgcatagaagatctatcaggagaggtagaacgacacctgcatgggtacaacagatggatcaccctcgaggatatccgatctagatcatccctactagactacagttgtttgtaagccggacattaatgaaaagggcgaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 63 - DNA, 6648 bp, Artificial Sequence
  pH-G
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaaggaaagatggttcctcaggttcttttgtttgcacccctcctggtttctccattgtgtttcgggaagttccccatttacacgataccagacaaacttggtccctggagccctattgacttacaccatctcagctgtccaaataacctggttgtggaggacgaaggatgtaccaacctgtccgggttctcttacatggaacttaaagtgggatacatctcagccataaaagtgaacgggttcacttgcacaggtgttgtgacagaggcagaaacctacaccaactttgttggttatgtcacaaccacattcaagagaaagcatttccgccccaccccagacgcatgtagagccgcgtataactggaagatggccggtgaccccagatatgaagagtctctacacaatccgtaccccgactaccattggcttcgaactgtaaaaaccaccaaagagtctctcgttatcatatccccaagtgtgacagatttggacccatatgacaaatcccttcactcaagggtcttccctggcggaaattgctcaggaataacggtgtcctcgacctactgctcaactaatcatgattacaccatctggatgcctgagaatctgagactagggacatcttgtgacatttttacccatagcagagggaagagagcatccaaaggagacaagacttgcggctttgtggatgaaagaggcctgtataagtctttaaagggagcatgcaaactcaagttatgtggagttctcggacttagacttatggatggaacatgggtcgcgatgcaaacatcagatgagaccaaatggtgccctccaggtcagttggtgaatttgcacgactttcgctcagacgagattgagcatctcgttgaggaagagttagtcaagaaaagagaggagtgtctggatgcactagagtccatcatgaccaccaagtcagtgagtttcagacgtctcagtcacctgagaaaacttgtccctgggtttggaaaagcatataccatattcaacaaaaccttgatggaggctgatgctcactacaagtctgtccagacctggaatgagatcatcccctcaaaagggtgtttgagagttggggagaggtgtcatccccatgtgaacggggtgtttttcaatggtataatattagggtctgacggccatgttctaatcccagagatgcagtcatccctcctccagcaacatatggagttgttggaatcttcagttatccccctgatgcaccccttggcagacccttctacagttttcaaagacggtgatgaggttgaggattttgttgaagttcacctccccgatgtgcataaacaggtctcaggagttgacctgggtctcccgaaatgggggaagtatgtattgatgattgcaggggccttgattgccctgatgttgataattttcctgatgacatgttgcagaagagtcaatcgaccagaatctacacaaagcaatcttggagggacagggagaaatgtgtcagtcccttcccaaagcggaaaagtcatatcttcatgggagtcatataagagtggaggcgagaccagactgtgaaggccggtcatccttttgacacctcaagtccagaggataacctcctctcggggttggggggaatcttgggatccactagtccagtgtggtggaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 64 - DNA, 13208 bp, Artificial Sequence
  pHS 717-AG1 r1
actagtatttaggtgacactatagcaatgggagctaacggacctcgcttaggactcctattcccatggagaaactcctagatgaggttcttgcccccggtgggccttataacttaaccgtcggcagttgggtaagagaccatgtccgctcaattgtcgagggcgcgtgggaagtgcgcgatgtcgtcaccgctgcccaaaagcgggccatcgtagctgtgatacccagacctgtattcacgcagatgcaggttagtgatcacccagcactccacgcaatttcgcggtatacccgccgccattggatcgagtggggccctaaagaagccctacacgtcctcatcgacccgagcccgggcctgctccgcgaggtcgctcgcgttgagcgccgctgggtcgcactgtgcctccacaggacggcacgcaaactcgccaccgccctggccgagacggccggcgaggcgtggcatgccgactacgtgtgcgcgctgcgtggcgcaccgagcggccccttctacgtccaccctgaggacgtcccgcacggcggccgcgccgtggcggacagatgcttgctctactacacacccatgcagatgtgcgagctgatgcgtgccattgacgccaccttgctcgtggcggttgacttgtggccggtcgcccttgcggctcatgtcggcgacgactgggacgacctgggcatcgcctggcacctcgaccatgacggcggctgccccgccgactgccgcggagccggcgctgggcccacgcccggctacacccgcccctgcaccacacgcatctaccaagtcctgccggacaccgcccaccccgggcgcctctaccggtgcgggccccgcctgtggacgcgcgattgcgccgtggccgaactctcatgggaggttgcccagcactgcgggcaccaggcgcgcgtgcgcgccgtgcgatgcaccctccccatccgccacgtgcgcagcctccaacccagcgcacgggtccgactcccggacctcgtccatctcgccgaggtgggccggtggcggtggttcagcctcccccgccccgtgttccagcgcatgctgtcctactgcaagaccctgagccccgacgcgtactacagcgagcgtgtgttcaagttcaagaacgccctgagccacagcatcacgctcgcgggcaatgtgctgcaagaggggtggaagggcacgtgcgccgaggaagacgcgctgtgcgcatacgtagccttccgcgcgtggcagtctaacgccaggttggcggggatcatgaaaggcgctaagcgctgcgctgccgactctttgagcgtggccggctggctggacaccatttgggacgccatcaagcggttcttcggcagcgtgcccctcgccgagcgcatggaggagtgggaacaggacgccgcggtcgccgccttcgaccgcggcccccttgaggacggcgggcgccacttggacaccgtgcaacccccgaagtcgccgccccgccctgagatcgccgcgacctggatcgtccacgcagccagcgcagaccgccattgcgcgtgcgctccccgctgcgacgtcccgcgcgaacgtccttccgcgcccgccggcccgcccgatgacgaggcgctcatcccgccgtggctgttcgccgagcgccgtgccctccgctgccgcgagtgggactttgaggctctccgcgcgcgcgccgatacggcggccgcgcccgccccgctggccccacgccctgcgcggtaccccactgtgctctaccgccaccccgcccaccacggcccgtggctcacccttgacgagccgggcgaggctgacgcggccctggtcttatgcgacccgcttggccagccgctccggggccctgaacgccacttcgccgccggcgcgcacatgtgcgcgcaggcgcgcgggctccaggcttttgtccgtgttgtgcctccacccgaacgcccctgggccgacgggggcgccagagcgtgggcaaaattcttccgcggctgcgcctgggcgcagcgcttgctcggcgagccggcagtgatgcacctcccatacaccgatggtgacgtgccacagctgatcgcgctggccttgcgcacgctggcccagcagggggccgccttggcactctcggtgcgagacctgcccgggggtgcagcgttcgacgcgaatgcggttaccgccgcagtgcgcgctggccccggccagtccaagcttggtggttcaggaggaggatcgacccaaggaaccggtatggtgagcgtgatcaagcccgagatgaagatcaagctgtgcatgaggggcaccgtgaacggccacaacttcgtgatcgagggcgagggcaagggcaacccctacgagggcacccagatcctggacctgaacgtgaccgagggcgcccccctgcccttcgcctacgacatcctgaccaccgtgttccagtacggcaacagggccttcaccaagtaccccgccgacatccaggactacttcaagcagaccttccccgagggctaccactgggagaggagcatgacctacgaggaccagggcatctgcaccgccaccagcaacatcagcatgaggggcgactgcttcttctacgacatcaggttcgacggcaccaacttcccccccaacggccccgtgatgcagaagaagaccctgaagtgggagcccagcaccgagaagatgtacgtggaggacggcgtgctgaagggcgacgtgaacatgaggctgctgctggagggcggcggccactacaggtgcgacttcaagaccacctacaaggccaagaaggaggtgaggctgcccgacgcccacaagatcgaccacaggatcgagatcctgaagcacgacaaggactacaacaaggtgaagctgtacgagaacgccgtggccaggtactccatgctgcccagccaggccaagaccggtaattccgctgacggcggcggaggatcgggtggtagtaagcttgcggccacgtcaccgccacccggcgaccccccgccaccgcgccgcgcacggcgatcgcaacggcactcggacgcccgcagcactccgccctccgcgcctgcgcgcgacccgccgccgcccgcccccagcccgcccgcgccaccccgcgcgggtgacctggccccccccattctcgcggggccggcggatcgcgcgcgtgacgccgagctggaggtcgcctgcgaaccgagcggcccccccgcgccaaccaaggcagacccagacagcgacatcgttgaaagttacgcccgcgccgccgggcccgtgcacctccgggtccgtgacatcatggacccaccgcctgggtgcaaggtcgtggtcaacgccgccaacgaggggctgctggccggctttggcgtgtgtggtgccatctttgccaacgccacggcggcccttgctgcagactgccggcgcctcgccccatgccccaccggcgaggcagtggcgacacccggccacggctgcgggtacacccacatcatccacgccgttgccccgcggcgccctcgggaccccgccgccctcgaggagggcgaggcactgctcgagcgcgcctaccgcagcatcgtcgcgctagctgctgcgcgtaggtggacgtgtatcgcgtgccccctcctcggcgctggcgtctacggctggtctgctgcggagtccctccgcgccgcgcttgcggccacgcgcgccgagcccgccgagcgcgtgagcctgcacatctgccaccccgaccgcgccacgctgacgcacgcctccgtgctcgttggcgcggggctcgctgccaggcgcgtcagcccccctccggccgagcccctcgcatcttgccccgccggcgacccgggccggccggctcagcgcagcgcgtcgcccccagcgaaaccccttggggatgccgccgcgcccgagccccgcggatgccaggggtgcgaactctgccggtacacgcgcgtcactaatgaccgcgcctatgtcaacctgtggctcgagcgcgaccgcggcgccaccagctgggcgatgcgcattcccgaggtggttgtctacgggccggagcacctcgccacgcattttccattgaaccactacagtgtgctcaagcccgcggaggtcaggcccccgcgaggcatgtgcgggagtgacatgtggcgctgccgcggctggcagggcatgccgcaggtgcggtgcaccccctccaacgcccacgccgccctgtgccgcacaggcgtaccccctcgagtgagcacgcgaggcggcgagctagacccaaacacctgctggctccgcgccgccgccaacgttgcgcaggctgcgcgcgcctgcggcgcctacacgagcgccgggtgccccaagtgcgcctacggccgcgccttgagcgaagcccgcactcatgaggactttgccgccctgagccagcggtggagcgcgagccacgccgatgcctcccctgacggcaccggagatcccctcgaccccctgatggagaccgtgggatgcgcctgttcgcgcgtgtgggtcggctccgagcacgaggccccgcccgaccacctcctggtgtccctccaccgcgcccccaatggtccgtggggcgtagtgctcgaggtgcgcgcgcgccccgaagggggcaaccccaccggccacttcgtttgcgcggtcggcggcggcccacgccgcgtctcggaccgcccccatctttggctcgcggtccccctgtctcggggcggcggcacctgcgccgtgaccgacgaggggctggcccaggcgtactacgacgatctcgaggtgcgccgcctcggggatgacgccatggcccgggcggccctcgcatcagtccaacgccctcgcaaaggcccctacaatattagggtatggaacatggccgcaggcgctggcaagactacccgcatcctcgctgccttcacgcgcgaagacctctacgtctgccccaccaatgcgctcctgcacgagattcaggccaaactccgcgcgcgcgacatcgacatcaagaacgccgccacctacgagcgcgcgctcacgaaaccgctcgccgcctaccgccgcatctacattgatgaggcgttcaccctcggcggcgagtactgcgcgttcgttgccagccaaaccacagcggaggtgatctgcgtcggtgaccgagaccagtgcggcccacactacgccaacaactgccgcacccctgtccccgaccgctggcctaccgagcgctcacgccacacttggcgcttccccgactgctgggccgcccgcctgcgcgcggggctcgattatgacatcgagggcgagcgcatcggcaccttcgcctgcaacctttgggacggccgccaggtcgaccttcacctcgccttctcgcgcgaaaccgtgcgccgccttcacgaggctggcatacgcgcatacaccgtgcgcgaggcccagggcatgagcgtcggcaccgcctgcatccatgtaggcagggacggcacggacgttgccctggcgctgacacgcgaccttgccatcgtcagcctgacccgggcctccgacgcgctctacctccacgagctcgaggacggctcactgcgcgctgcggggctcagcgcgttcctcgacgccggggcactggcggagctcaaggaggttcccgctggcatcgaccgcgttgtcgccgtcgaacaggcaccaccaccgttgccgcccgccgacggcatccccgaggcccaagacgtgccacccttctgtccccgcactctggaggagctcgtcttcggccgtgccggccacccccattacgcggacctcaaccgcgtgaccgagggcgaacgggaagtgcggtatatgcgcatctcgcgccacctgctcaacaagaatcataccgagatgcctgggacggaacgcgtcctcagtgccgtttgcgccgtgcggcgctaccgcgcgggcgaggatgggtcgaccctccgcactgctgtggcccgccagcacccgcgccctttccgccagatcccacccccgcgcgtcactgctggggtcgcccaggagtggcgcatgacatacctgcgggaacggatcgacctcactgatgtctacacgcagatgggcgtggctgcgcgggagctcaccgaccgctacgcgcgccgctaccctgagatcttcgccggcatgtgtaccgcccagagcctgagcgtccccgccttcctcaaagccaccctgaagtgcgtagacgccgccctcggccccagcgacaccgaggactgtcacgccgcccaggggaaagccggccttgaaatccgggcgtgggccaaggagtgggttcaggtcatgtccccgcatttccgtgctatccagaagatcatcatgcgcgccttgcgcccgcaattccttgtggccgcaggccatacggagcccgaggtcgatgcgtggtggcaggctcactacaccaccaacgccatcgaggtcgacttcaccgagttcgacatgaaccagaccctcgctactcgggacgtcgagctcgagattagcgccgctctcttgggcctcccctgcgccgaagactaccgtgcactccgcgctggcagctactgcaccctgcgcgaactgggtaccactgagaccggctgcgagcgcacaagcggcgagcccgccacgctgctgcacaacaccaccgtggccatgtgcatggctatgcgcatggtccccaaaggcgtgcgctgggccgggattttccagggcgacgacatggtcatcttcctccctgagggcgcgcgcagcgcggcacttaagtggacccccgccgaggtgggcttgtttggcttccacatcccggtgaagcatgtgagcacccctacccccagtttctgcgggcacgtcggcaccgcggccggcctcttccatgatgtcatgcaccaggcgatcaaggtgctctgccgccgtttcgacccagacgtgcttgaagaacagcaggtggccctcctcgaccgcctccggggggtctacgcggccctgcctgacaccgttgccgccaatgccgcgtactacgactacagcgccgagcgcgtcctcgccattgtgcgcgaacttaccgcgtacgcgcgggggcgcggcctcgaccacccggccaccatcggcgcgctcgaggagatccagaccccctacgcgcgcgccaatctccacgacgccgactaacgcccctgtacgtggggcctttaatcttacctactctaaccaggtcatcacccaccgttgtttcgccgcatctggtgggtaccccactcttgccattcgggagagccccagggtgcccgaatggcttctactacccccatcaccatggaggacctccagaaggccctcgaggcacaatcccgcgccctgcgtgcggaactcgccgccggcgcctcgcagacgcgccggccgcggccgccgcgacagcgcgactccagcacctccggagacgactccggccgtgactccggagggccccgccgccgccgcggcaaccggggccgtggccagcgcagggactggtctagggccccgccccccccggaagagcggcaagaaagccgctcccagactccggccccgaagccatcgcgggcgccgccacaacagcctcaacccccgcgtatgcaaaccgggcgtgggggctctgccccgcgccccgagctggggccaccgaccaacccgttccaagcagccgtagcgcgtggcctgcgcccgcctctccacgatcctgacaccgaggcacccaccgaggcctgcgtaacctcatggctttggagcgaaggtgaaggcgcggtcttttaccgcgtcgatttacactttaccaacctgggcacccccccactcgacgaggacggccgctgggaccctgcgctcatgtacaacccttgcgggcccgagccgcccgctcacgtcgtccgtgcatacaatcaacctgccggcgacgtcaggggcgtttggggtaaaggtgagcgcacttacgctgagcaggatttccgcgttggcggcacgcgctggcaccgactgctgcgcatgccagtgcgcggcctcgacggcgacagcgccccgctacccccccacaccaccgaacgcatcgagacccgctcggcgcgccatccctggcgcatccgtttcggcgctccccaggccttccttgccgggctcttgctcgccgcggtcgccgtaggcaccgcgcgcgccgggctccagccccgcgctgacatggcggcacccccagtgccgccgcagcccccccgtgcgcacgggcagcattacggccatcaccaccatcagctgccgttcctcgggcacgacggccatcacggcggcaccttgcgtgtcggccagcatcaccgaaacgccagcgacgtgctgcccggccactggctccagggtggctggggttgctacaacctgagcgactggcaccagggcactcatgtctgtcacaccaagcacatggacttctggtgtgtggagcacgaccgaccgccgcccgcgactccgacgcctctcaccaccgcggcgaatgccacaaccgccgccacccccgccaccgccccggccccctgccacgccggcctcaatgacagctgcggcggcttcctgtcagggtgcgggccgatgcgcctgcgccacggcgccgacacccggtgcggtcggttgatctgcgggctgtccaccaccgcccagtacccgcctacccggttcggctgcgccatgcggtggggccttcccccctgggaattggtcgttctcaccgcccgccctgaagacggctggacctgccgcggcgtgcccgcccacccaggcacccgctgccccgaactggtgagccccatgggacgcgcgacttgctccccggcctcggcgctctggctcgccacagcgaacgcgctgtctcttgatcacgccctcgcggccttcgtcctgctggtcccgtgggtcctgatattcatggtgtgccgccgcgcctgccgccgccgcggcgccgccgccgcccttaccgcggtcgtcctgcaggggtacaacccccccgcctacggcgaggaggctttcacctacctctgtactgcaccggggtgcgccactcaaacacctgtccccgtgcgcctcgctggcgtccgctttgagtccaagatcgtggacggtggctgctttgccccatgggacctcgaggccactggagcctgcatttgcgagatccccaccgacgtctcgtgcgagggcttgggggcctgggtacccacagccccttgcgcgcgcatctggaacggcacacagcgcgcatgcaccttttgggctgtcaatgcctactcctctggtgggtacgcgcagctggcctcttacttcaaccctggcggcagctactacaagcagtaccaccctaccgcgtgcgaggttgaacctgccttcggccacagcgacgcggcctgctggggcttccccaccgacaccgtgatgagcgtgttcgcccttgccagctacgtccagcaccctcacaagaccgtccgggtcaagttccatacagagaccaggaccgtctggcagctctccgttgccggcgtgtcgtgcaacgtcaccaccgaacacccgttctgcaacacgccgcacggacaactcgaggtccaggtcccgcccgaccccggagacctggttgagtacatcatgaattacaccggcaatcagcagtcccggtggggcctcgggagcccgaattgccatggccccgattgggcctccccggtttgtcaacgccattcccctgactgctcgcggcttgtgggggccacgccagagcgtccccggctgcgcctggttgatgctgacgaccccctgctgcgcactgcccctgggcccggcgaggtgtgggtcacgcccgtcataggctctcaggcgcgcaagtgcggactccacatacgcgccgggccgtacggccatgccaccgtcgaaatgcccgagtggatccacgctcacaccaccagcgacccctggcacccaccgggccccttggggctcaagtttaagacagttcgcccggttgcgctaccacgcgcgttagcgccaccccgcaatgtgcgtgtgaccgggtgctaccagtgcggtacccccgcgctggtggaaggccttgcccccggggggggcaattgccatctcaccgtcaatggcgaggacgtcggcgccttcccccctgggaagttcgttaccgccgccctcctcaacacccccccgccctaccaagtcagctgcgggggcgagagcgatcgcgcgagcgcgcgggttattgaccccgccgcgcaatcgttcaccggcgtggtgtatggcacacacaccactgctgtgtcggagacccggcagacctgggcggagtgggctgccgcccattggtggcagctcactctgggcgctatttgcaccctcctactcgctggcttactcgcttgctgtgccaaatgcttgtactacttgcgcggcgctatagcgccgcgctagtgggcccccgcgcgaaacccgcattagcccactggattcccgcacctgttgctgcatagaaaaaaaaaaaaaaaaaaagaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgcc

SEQ ID NO: 65 - DNA, 14234 bp, Artificial Sequence
  pHS-717AG1-1005pMag-nMaghigh r2
actagtatttaggtgacactatagcaatgggagctaacggacctcgcttaggactcctattcccatggagaaactcctagatgaggttcttgcccccggtgggccttataacttaaccgtcggcagttgggtaagagaccatgtccgctcaattgtcgagggcgcgtgggaagtgcgcgatgtcgtcaccgctgcccaaaagcgggccatcgtagctgtgatacccagacctgtattcacgcagatgcaggttagtgatcacccagcactccacgcaatttcgcggtatacccgccgccattggatcgagtggggccctaaagaagccctacacgtcctcatcgacccgagcccgggcctgctccgcgaggtcgctcgcgttgagcgccgctgggtcgcactgtgcctccacaggacggcacgcaaactcgccaccgccctggccgagacggccggcgaggcgtggcatgccgactacgtgtgcgcgctgcgtggcgcaccgagcggccccttctacgtccaccctgaggacgtcccgcacggcggccgcgccgtggcggacagatgcttgctctactacacacccatgcagatgtgcgagctgatgcgtgccattgacgccaccttgctcgtggcggttgacttgtggccggtcgcccttgcggctcatgtcggcgacgactgggacgacctgggcatcgcctggcacctcgaccatgacggcggctgccccgccgactgccgcggagccggcgctgggcccacgcccggctacacccgcccctgcaccacacgcatctaccaagtcctgccggacaccgcccaccccgggcgcctctaccggtgcgggccccgcctgtggacgcgcgattgcgccgtggccgaactctcatgggaggttgcccagcactgcgggcaccaggcgcgcgtgcgcgccgtgcgatgcaccctccccatccgccacgtgcgcagcctccaacccagcgcacgggtccgactcccggacctcgtccatctcgccgaggtgggccggtggcggtggttcagcctcccccgccccgtgttccagcgcatgctgtcctactgcaagaccctgagccccgacgcgtactacagcgagcgtgtgttcaagttcaagaacgccctgagccacagcatcacgctcgcgggcaatgtgctgcaagaggggtggaagggcacgtgcgccgaggaagacgcgctgtgcgcatacgtagccttccgcgcgtggcagtctaacgccaggttggcggggatcatgaaaggcgctaagcgctgcgctgccgactctttgagcgtggccggctggctggacaccatttgggacgccatcaagcggttcttcggcagcgtgcccctcgccgagcgcatggaggagtgggaacaggacgccgcggtcgccgccttcgaccgcggcccccttgaggacggcgggcgccacttggacaccgtgcaacccccgaagtcgccgccccgccctgagatcgccgcgacctggatcgtccacgcagccagcgcagaccgccattgcgcgtgcgctccccgctgcgacgtcccgcgcgaacgtccttccgcgcccgccggcccgcccgatgacgaggcgctcatcccgccgtggctgttcgccgagcgccgtgccctccgctgccgcgagtgggactttgaggctctccgcgcgcgcgccgatacggcggccgcgcccgccccgctggccccacgccctgcgcggtaccccactgtgctctaccgccaccccgcccaccacggcccgtggctcacccttgacgagccgggcgaggctgacgcggccctggtcttatgcgacccgcttggccagccgctccggggccctgaacgccacttcgccgccggcgcgcacatgtgcgcgcaggcgcgcgggctccaggcttttgtccgtgttgtgcctccacccgaacgcccctgggccgacgggggcgccagagcgtgggcaaaattcttccgcggctgcgcctgggcgcagcgcttgctcggcgagccggcagtgatgcacctcccatacaccgatggtgacgtgccacagctgatcgcgctggccttgcgcacgctggcccagcagggggccgccttggcactctcggtgcgagacctgcccgggggtgcagcgttcgacgcgaatgcggttaccgccgcagtgcgcgctggccccggccagtccaagcttggtggttcaggaggaggatcgacccaaggaaccggtatggtgagcgtgatcaagcccgagatgaagatcaagctgtgcatgaggggcaccgtgaacggccacaacttcgtgatcgagggcgagggcaagggcaacccctacgagggcacccagatcctggacctgaacgtgaccgagggcgcccccctgcccttcgcctacgacatcctgaccaccgtgttccagtacggcaacagggccttcaccaagtaccccgccgacatccaggactacttcaagcagaccttccccgagggctaccactgggagaggagcatgacctacgaggaccagggcatctgcaccgccaccagcaacatcagcatgaggggcgactgcttcttctacgacatcaggttcgacggcaccaacttcccccccaacggccccgtgatgcagaagaagaccctgaagtgggagcccagcaccgagaagatgtacgtggaggacggcgtgctgaagggcgacgtgaacatgaggctgctgctggagggcggcggccactacaggtgcgacttcaagaccacctacaaggccaagaaggaggtgaggctgcccgacgcccacaagatcgaccacaggatcgagatcctgaagcacgacaaggactacaacaaggtgaagctgtacgagaacgccgtggccaggtactccatgctgcccagccaggccaagaccggtaattccgctgacggcggcggaggatcgggtggtagtaagcttgcggccacgtcaccgccacccggcgaccccccgccaccgcgccgcgcacggcgatcgcaacggcactcggacgcccgcagcactccgccctccgcgcctgcgcgcgacccgccgccgcccgcccccagcccgcccgcgccaccccgcgcgggtgacctggccccccccattctcgcggggccggcggatcgcgcgcgtgacgccgagctggaggtcgcctgcgaaccgagcggcccccccgcgccaaccaaggcagacccagacagcgacatcgttgaaagttacgcccgcgccgccgggcccgtgcacctccgggtccgtgacatcatggacccaccgcctgggtgcaaggtcgtggtcaacgccgccaacgaggggctgctggccggctttggcgtgtgtggtgccatctttgccaacgccacggcggcccttgctgcagactgccggcgcctcgccccatgccccaccggcgaggcagtggcgacacccggccacggctgcgggtacacccacatcatccacgccgttgccccgcggcgccctcgggaccccgccgccctcgaggagggcgaggcactgctcgagcgcgcctaccgcagcatcgtcgcgctagctgctgcgcgtaggtggacgtgtatcgcgtgccccctcctcggcgctggcgtctacggctggtctgctgcggagtccctccgcgccgcgcttgcggccacgcgcgccgagcccgccgagcgcgtgagcctgcacatctgccaccccgaccgcgccacgctgacgcacgcctccgtgctcgttggcgcggggctcgctgccaggcgcgtcagcccccctccggccgagcccctcgcatcttgccccgccaagcttagccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaaaccggtaattccgctgacggcggcggaggatcgggtggtagtggtggttcaggaggaggatcgacccaaggaggatccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatccgcaaggcaatcgacaggaatgccgaggtgcaggttgaagtagtcaattttaaaaagaatggacagcgatttgttaatttcctgactatcatacctgttagggacgaaacaggcgagtatcgatactctatgggattccagtgcgaaacagaatatccgtacgacgtcccagattacgcgggcaagcttggcgacccgggccggccggctcagcgcagcgcgtcgcccccagcgaaaccccttggggatgccgccgcgcccgagccccgcggatgccaggggtgcgaactctgccggtacacgcgcgtcactaatgaccgcgcctatgtcaacctgtggctcgagcgcgaccgcggcgccaccagctgggcgatgcgcattcccgaggtggttgtctacgggccggagcacctcgccacgcattttccattgaaccactacagtgtgctcaagcccgcggaggtcaggcccccgcgaggcatgtgcgggagtgacatgtggcgctgccgcggctggcagggcatgccgcaggtgcggtgcaccccctccaacgcccacgccgccctgtgccgcacaggcgtaccccctcgagtgagcacgcgaggcggcgagctagacccaaacacctgctggctccgcgccgccgccaacgttgcgcaggctgcgcgcgcctgcggcgcctacacgagcgccgggtgccccaagtgcgcctacggccgcgccttgagcgaagcccgcactcatgaggactttgccgccctgagccagcggtggagcgcgagccacgccgatgcctcccctgacggcaccggagatcccctcgaccccctgatggagaccgtgggatgcgcctgttcgcgcgtgtgggtcggctccgagcacgaggccccgcccgaccacctcctggtgtccctccaccgcgcccccaatggtccgtggggcgtagtgctcgaggtgcgcgcgcgccccgaagggggcaaccccaccggccacttcgtttgcgcggtcggcggcggcccacgccgcgtctcggaccgcccccatctttggctcgcggtccccctgtctcggggcggcggcacctgcgccgtgaccgacgaggggctggcccaggcgtactacgacgatctcgaggtgcgccgcctcggggatgacgccatggcccgggcggccctcgcatcagtccaacgccctcgcaaaggcccctacaatattagggtatggaacatggccgcaggcgctggcaagactacccgcatcctcgctgccttcacgcgcgaagacctctacgtctgccccaccaatgcgctcctgcacgagattcaggccaaactccgcgcgcgcgacatcgacatcaagaacgccgccacctacgagcgcgcgctcacgaaaccgctcgccgcctaccgccgcatctacattgatgaggcgttcaccctcggcggcgagtactgcgcgttcgttgccagccaaaccacagcggaggtgatctgcgtcggtgaccgagaccagtgcggcccacactacgccaacaactgccgcacccctgtccccgaccgctggcctaccgagcgctcacgccacacttggcgcttccccgactgctgggccgcccgcctgcgcgcggggctcgattatgacatcgagggcgagcgcatcggcaccttcgcctgcaacctttgggacggccgccaggtcgaccttcacctcgccttctcgcgcgaaaccgtgcgccgccttcacgaggctggcatacgcgcatacaccgtgcgcgaggcccagggcatgagcgtcggcaccgcctgcatccatgtaggcagggacggcacggacgttgccctggcgctgacacgcgaccttgccatcgtcagcctgacccgggcctccgacgcgctctacctccacgagctcgaggacggctcactgcgcgctgcggggctcagcgcgttcctcgacgccggggcactggcggagctcaaggaggttcccgctggcatcgaccgcgttgtcgccgtcgaacaggcaccaccaccgttgccgcccgccgacggcatccccgaggcccaagacgtgccacccttctgtccccgcactctggaggagctcgtcttcggccgtgccggccacccccattacgcggacctcaaccgcgtgaccgagggcgaacgggaagtgcggtatatgcgcatctcgcgccacctgctcaacaagaatcataccgagatgcctgggacggaacgcgtcctcagtgccgtttgcgccgtgcggcgctaccgcgcgggcgaggatgggtcgaccctccgcactgctgtggcccgccagcacccgcgccctttccgccagatcccacccccgcgcgtcactgctggggtcgcccaggagtggcgcatgacatacctgcgggaacggatcgacctcactgatgtctacacgcagatgggcgtggctgcgcgggagctcaccgaccgctacgcgcgccgctaccctgagatcttcgccggcatgtgtaccgcccagagcctgagcgtccccgccttcctcaaagccaccctgaagtgcgtagacgccgccctcggccccagcgacaccgaggactgtcacgccgcccaggggaaagccggccttgaaatccgggcgtgggccaaggagtgggttcaggtcatgtccccgcatttccgtgctatccagaagatcatcatgcgcgccttgcgcccgcaattccttgtggccgcaggccatacggagcccgaggtcgatgcgtggtggcaggctcactacaccaccaacgccatcgaggtcgacttcaccgagttcgacatgaaccagaccctcgctactcgggacgtcgagctcgagattagcgccgctctcttgggcctcccctgcgccgaagactaccgtgcactccgcgctggcagctactgcaccctgcgcgaactgggtaccactgagaccggctgcgagcgcacaagcggcgagcccgccacgctgctgcacaacaccaccgtggccatgtgcatggctatgcgcatggtccccaaaggcgtgcgctgggccgggattttccagggcgacgacatggtcatcttcctccctgagggcgcgcgcagcgcggcacttaagtggacccccgccgaggtgggcttgtttggcttccacatcccggtgaagcatgtgagcacccctacccccagtttctgcgggcacgtcggcaccgcggccggcctcttccatgatgtcatgcaccaggcgatcaaggtgctctgccgccgtttcgacccagacgtgcttgaagaacagcaggtggccctcctcgaccgcctccggggggtctacgcggccctgcctgacaccgttgccgccaatgccgcgtactacgactacagcgccgagcgcgtcctcgccattgtgcgcgaacttaccgcgtacgcgcgggggcgcggcctcgaccacccggccaccatcggcgcgctcgaggagatccagaccccctacgcgcgcgccaatctccacgacgccgactaacgcccctgtacgtggggcctttaatcttacctactctaaccaggtcatcacccaccgttgtttcgccgcatctggtgggtaccccactcttgccattcgggagagccccagggtgcccgaatggcttctactacccccatcaccatggaggacctccagaaggccctcgaggcacaatcccgcgccctgcgtgcggaactcgccgccggcgcctcgcagacgcgccggccgcggccgccgcgacagcgcgactccagcacctccggagacgactccggccgtgactccggagggccccgccgccgccgcggcaaccggggccgtggccagcgcagggactggtctagggccccgccccccccggaagagcggcaagaaagccgctcccagactccggccccgaagccatcgcgggcgccgccacaacagcctcaacccccgcgtatgcaaaccgggcgtgggggctctgccccgcgccccgagctggggccaccgaccaacccgttccaagcagccgtagcgcgtggcctgcgcccgcctctccacgatcctgacaccgaggcacccaccgaggcctgcgtaacctcatggctttggagcgaaggtgaaggcgcggtcttttaccgcgtcgatttacactttaccaacctgggcacccccccactcgacgaggacggccgctgggaccctgcgctcatgtacaacccttgcgggcccgagccgcccgctcacgtcgtccgtgcatacaatcaacctgccggcgacgtcaggggcgtttggggtaaaggtgagcgcacttacgctgagcaggatttccgcgttggcggcacgcgctggcaccgactgctgcgcatgccagtgcgcggcctcgacggcgacagcgccccgctacccccccacaccaccgaacgcatcgagacccgctcggcgcgccatccctggcgcatccgtttcggcgctccccaggccttccttgccgggctcttgctcgccgcggtcgccgtaggcaccgcgcgcgccgggctccagccccgcgctgacatggcggcacccccagtgccgccgcagcccccccgtgcgcacgggcagcattacggccatcaccaccatcagctgccgttcctcgggcacgacggccatcacggcggcaccttgcgtgtcggccagcatcaccgaaacgccagcgacgtgctgcccggccactggctccagggtggctggggttgctacaacctgagcgactggcaccagggcactcatgtctgtcacaccaagcacatggacttctggtgtgtggagcacgaccgaccgccgcccgcgactccgacgcctctcaccaccgcggcgaatgccacaaccgccgccacccccgccaccgccccggccccctgccacgccggcctcaatgacagctgcggcggcttcctgtcagggtgcgggccgatgcgcctgcgccacggcgccgacacccggtgcggtcggttgatctgcgggctgtccaccaccgcccagtacccgcctacccggttcggctgcgccatgcggtggggccttcccccctgggaattggtcgttctcaccgcccgccctgaagacggctggacctgccgcggcgtgcccgcccacccaggcacccgctgccccgaactggtgagccccatgggacgcgcgacttgctccccggcctcggcgctctggctcgccacagcgaacgcgctgtctcttgatcacgccctcgcggccttcgtcctgctggtcccgtgggtcctgatattcatggtgtgccgccgcgcctgccgccgccgcggcgccgccgccgcccttaccgcggtcgtcctgcaggggtacaacccccccgcctacggcgaggaggctttcacctacctctgtactgcaccggggtgcgccactcaaacacctgtccccgtgcgcctcgctggcgtccgctttgagtccaagatcgtggacggtggctgctttgccccatgggacctcgaggccactggagcctgcatttgcgagatccccaccgacgtctcgtgcgagggcttgggggcctgggtacccacagccccttgcgcgcgcatctggaacggcacacagcgcgcatgcaccttttgggctgtcaatgcctactcctctggtgggtacgcgcagctggcctcttacttcaaccctggcggcagctactacaagcagtaccaccctaccgcgtgcgaggttgaacctgccttcggccacagcgacgcggcctgctggggcttccccaccgacaccgtgatgagcgtgttcgcccttgccagctacgtccagcaccctcacaagaccgtccgggtcaagttccatacagagaccaggaccgtctggcagctctccgttgccggcgtgtcgtgcaacgtcaccaccgaacacccgttctgcaacacgccgcacggacaactcgaggtccaggtcccgcccgaccccggagacctggttgagtacatcatgaattacaccggcaatcagcagtcccggtggggcctcgggagcccgaattgccatggccccgattgggcctccccggtttgtcaacgccattcccctgactgctcgcggcttgtgggggccacgccagagcgtccccggctgcgcctggttgatgctgacgaccccctgctgcgcactgcccctgggcccggcgaggtgtgggtcacgcccgtcataggctctcaggcgcgcaagtgcggactccacatacgcgccgggccgtacggccatgccaccgtcgaaatgcccgagtggatccacgctcacaccaccagcgacccctggcacccaccgggccccttggggctcaagtttaagacagttcgcccggttgcgctaccacgcgcgttagcgccaccccgcaatgtgcgtgtgaccgggtgctaccagtgcggtacccccgcgctggtggaaggccttgcccccggggggggcaattgccatctcaccgtcaatggcgaggacgtcggcgccttcccccctgggaagttcgttaccgccgccctcctcaacacccccccgccctaccaagtcagctgcgggggcgagagcgatcgcgcgagcgcgcgggttattgaccccgccgcgcaatcgttcaccggcgtggtgtatggcacacacaccactgctgtgtcggagacccggcagacctgggcggagtgggctgccgcccattggtggcagctcactctgggcgctatttgcaccctcctactcgctggcttactcgcttgctgtgccaaatgcttgtactacttgcgcggcgctatagcgccgcgctagtgggcccccgcgcgaaacccgcattagcccactggattcccgcacctgttgctgcatagaaaaaaaaaaaaaaaaaaagaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgcc

SEQ ID NO: 66 - DNA, 14234 bp, Artificial Sequence
  pHS-717pMag-nMaghigh-1005AG1 r3
actagtatttaggtgacactatagcaatgggagctaacggacctcgcttaggactcctattcccatggagaaactcctagatgaggttcttgcccccggtgggccttataacttaaccgtcggcagttgggtaagagaccatgtccgctcaattgtcgagggcgcgtgggaagtgcgcgatgtcgtcaccgctgcccaaaagcgggccatcgtagctgtgatacccagacctgtattcacgcagatgcaggttagtgatcacccagcactccacgcaatttcgcggtatacccgccgccattggatcgagtggggccctaaagaagccctacacgtcctcatcgacccgagcccgggcctgctccgcgaggtcgctcgcgttgagcgccgctgggtcgcactgtgcctccacaggacggcacgcaaactcgccaccgccctggccgagacggccggcgaggcgtggcatgccgactacgtgtgcgcgctgcgtggcgcaccgagcggccccttctacgtccaccctgaggacgtcccgcacggcggccgcgccgtggcggacagatgcttgctctactacacacccatgcagatgtgcgagctgatgcgtgccattgacgccaccttgctcgtggcggttgacttgtggccggtcgcccttgcggctcatgtcggcgacgactgggacgacctgggcatcgcctggcacctcgaccatgacggcggctgccccgccgactgccgcggagccggcgctgggcccacgcccggctacacccgcccctgcaccacacgcatctaccaagtcctgccggacaccgcccaccccgggcgcctctaccggtgcgggccccgcctgtggacgcgcgattgcgccgtggccgaactctcatgggaggttgcccagcactgcgggcaccaggcgcgcgtgcgcgccgtgcgatgcaccctccccatccgccacgtgcgcagcctccaacccagcgcacgggtccgactcccggacctcgtccatctcgccgaggtgggccggtggcggtggttcagcctcccccgccccgtgttccagcgcatgctgtcctactgcaagaccctgagccccgacgcgtactacagcgagcgtgtgttcaagttcaagaacgccctgagccacagcatcacgctcgcgggcaatgtgctgcaagaggggtggaagggcacgtgcgccgaggaagacgcgctgtgcgcatacgtagccttccgcgcgtggcagtctaacgccaggttggcggggatcatgaaaggcgctaagcgctgcgctgccgactctttgagcgtggccggctggctggacaccatttgggacgccatcaagcggttcttcggcagcgtgcccctcgccgagcgcatggaggagtgggaacaggacgccgcggtcgccgccttcgaccgcggcccccttgaggacggcgggcgccacttggacaccgtgcaacccccgaagtcgccgccccgccctgagatcgccgcgacctggatcgtccacgcagccagcgcagaccgccattgcgcgtgcgctccccgctgcgacgtcccgcgcgaacgtccttccgcgcccgccggcccgcccgatgacgaggcgctcatcccgccgtggctgttcgccgagcgccgtgccctccgctgccgcgagtgggactttgaggctctccgcgcgcgcgccgatacggcggccgcgcccgccccgctggccccacgccctgcgcggtaccccactgtgctctaccgccaccccgcccaccacggcccgtggctcacccttgacgagccgggcgaggctgacgcggccctggtcttatgcgacccgcttggccagccgctccggggccctgaacgccacttcgccgccggcgcgcacatgtgcgcgcaggcgcgcgggctccaggcttttgtccgtgttgtgcctccacccgaacgcccctgggccgacgggggcgccagagcgtgggcaaaattcttccgcggctgcgcctgggcgcagcgcttgctcggcgagccggcagtgatgcacctcccatacaccgatggtgacgtgccacagctgatcgcgctggccttgcgcacgctggcccagcagggggccgccttggcactctcggtgcgagacctgcccgggggtgcagcgttcgacgcgaatgcggttaccgccgcagtgcgcgctggccccggccagtccaagcttagccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaaaccggtaattccgctgacggcggcggaggatcgggtggtagtggtggttcaggaggaggatcgacccaaggaggatccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatccgcaaggcaatcgacaggaatgccgaggtgcaggttgaagtagtcaattttaaaaagaatggacagcgatttgttaatttcctgactatcatacctgttagggacgaaacaggcgagtatcgatactctatgggattccagtgcgaaacagaatatccgtacgacgtcccagattacgcgggcaagcttgcggccacgtcaccgccacccggcgaccccccgccaccgcgccgcgcacggcgatcgcaacggcactcggacgcccgcagcactccgccctccgcgcctgcgcgcgacccgccgccgcccgcccccagcccgcccgcgccaccccgcgcgggtgacctggccccccccattctcgcggggccggcggatcgcgcgcgtgacgccgagctggaggtcgcctgcgaaccgagcggcccccccgcgccaaccaaggcagacccagacagcgacatcgttgaaagttacgcccgcgccgccgggcccgtgcacctccgggtccgtgacatcatggacccaccgcctgggtgcaaggtcgtggtcaacgccgccaacgaggggctgctggccggctttggcgtgtgtggtgccatctttgccaacgccacggcggcccttgctgcagactgccggcgcctcgccccatgccccaccggcgaggcagtggcgacacccggccacggctgcgggtacacccacatcatccacgccgttgccccgcggcgccctcgggaccccgccgccctcgaggagggcgaggcactgctcgagcgcgcctaccgcagcatcgtcgcgctagctgctgcgcgtaggtggacgtgtatcgcgtgccccctcctcggcgctggcgtctacggctggtctgctgcggagtccctccgcgccgcgcttgcggccacgcgcgccgagcccgccgagcgcgtgagcctgcacatctgccaccccgaccgcgccacgctgacgcacgcctccgtgctcgttggcgcggggctcgctgccaggcgcgtcagcccccctccggccgagcccctcgcatcttgccccgccaagcttggtggttcaggaggaggatcgacccaaggaaccggtatggtgagcgtgatcaagcccgagatgaagatcaagctgtgcatgaggggcaccgtgaacggccacaacttcgtgatcgagggcgagggcaagggcaacccctacgagggcacccagatcctggacctgaacgtgaccgagggcgcccccctgcccttcgcctacgacatcctgaccaccgtgttccagtacggcaacagggccttcaccaagtaccccgccgacatccaggactacttcaagcagaccttccccgagggctaccactgggagaggagcatgacctacgaggaccagggcatctgcaccgccaccagcaacatcagcatgaggggcgactgcttcttctacgacatcaggttcgacggcaccaacttcccccccaacggccccgtgatgcagaagaagaccctgaagtgggagcccagcaccgagaagatgtacgtggaggacggcgtgctgaagggcgacgtgaacatgaggctgctgctggagggcggcggccactacaggtgcgacttcaagaccacctacaaggccaagaaggaggtgaggctgcccgacgcccacaagatcgaccacaggatcgagatcctgaagcacgacaaggactacaacaaggtgaagctgtacgagaacgccgtggccaggtactccatgctgcccagccaggccaagaccggtaattccgctgacggcggcggaggatcgggtggtagtaagcttggcgacccgggccggccggctcagcgcagcgcgtcgcccccagcgaaaccccttggggatgccgccgcgcccgagccccgcggatgccaggggtgcgaactctgccggtacacgcgcgtcactaatgaccgcgcctatgtcaacctgtggctcgagcgcgaccgcggcgccaccagctgggcgatgcgcattcccgaggtggttgtctacgggccggagcacctcgccacgcattttccattgaaccactacagtgtgctcaagcccgcggaggtcaggcccccgcgaggcatgtgcgggagtgacatgtggcgctgccgcggctggcagggcatgccgcaggtgcggtgcaccccctccaacgcccacgccgccctgtgccgcacaggcgtaccccctcgagtgagcacgcgaggcggcgagctagacccaaacacctgctggctccgcgccgccgccaacgttgcgcaggctgcgcgcgcctgcggcgcctacacgagcgccgggtgccccaagtgcgcctacggccgcgccttgagcgaagcccgcactcatgaggactttgccgccctgagccagcggtggagcgcgagccacgccgatgcctcccctgacggcaccggagatcccctcgaccccctgatggagaccgtgggatgcgcctgttcgcgcgtgtgggtcggctccgagcacgaggccccgcccgaccacctcctggtgtccctccaccgcgcccccaatggtccgtggggcgtagtgctcgaggtgcgcgcgcgccccgaagggggcaaccccaccggccacttcgtttgcgcggtcggcggcggcccacgccgcgtctcggaccgcccccatctttggctcgcggtccccctgtctcggggcggcggcacctgcgccgtgaccgacgaggggctggcccaggcgtactacgacgatctcgaggtgcgccgcctcggggatgacgccatggcccgggcggccctcgcatcagtccaacgccctcgcaaaggcccctacaatattagggtatggaacatggccgcaggcgctggcaagactacccgcatcctcgctgccttcacgcgcgaagacctctacgtctgccccaccaatgcgctcctgcacgagattcaggccaaactccgcgcgcgcgacatcgacatcaagaacgccgccacctacgagcgcgcgctcacgaaaccgctcgccgcctaccgccgcatctacattgatgaggcgttcaccctcggcggcgagtactgcgcgttcgttgccagccaaaccacagcggaggtgatctgcgtcggtgaccgagaccagtgcggcccacactacgccaacaactgccgcacccctgtccccgaccgctggcctaccgagcgctcacgccacacttggcgcttccccgactgctgggccgcccgcctgcgcgcggggctcgattatgacatcgagggcgagcgcatcggcaccttcgcctgcaacctttgggacggccgccaggtcgaccttcacctcgccttctcgcgcgaaaccgtgcgccgccttcacgaggctggcatacgcgcatacaccgtgcgcgaggcccagggcatgagcgtcggcaccgcctgcatccatgtaggcagggacggcacggacgttgccctggcgctgacacgcgaccttgccatcgtcagcctgacccgggcctccgacgcgctctacctccacgagctcgaggacggctcactgcgcgctgcggggctcagcgcgttcctcgacgccggggcactggcggagctcaaggaggttcccgctggcatcgaccgcgttgtcgccgtcgaacaggcaccaccaccgttgccgcccgccgacggcatccccgaggcccaagacgtgccacccttctgtccccgcactctggaggagctcgtcttcggccgtgccggccacccccattacgcggacctcaaccgcgtgaccgagggcgaacgggaagtgcggtatatgcgcatctcgcgccacctgctcaacaagaatcataccgagatgcctgggacggaacgcgtcctcagtgccgtttgcgccgtgcggcgctaccgcgcgggcgaggatgggtcgaccctccgcactgctgtggcccgccagcacccgcgccctttccgccagatcccacccccgcgcgtcactgctggggtcgcccaggagtggcgcatgacatacctgcgggaacggatcgacctcactgatgtctacacgcagatgggcgtggctgcgcgggagctcaccgaccgctacgcgcgccgctaccctgagatcttcgccggcatgtgtaccgcccagagcctgagcgtccccgccttcctcaaagccaccctgaagtgcgtagacgccgccctcggccccagcgacaccgaggactgtcacgccgcccaggggaaagccggccttgaaatccgggcgtgggccaaggagtgggttcaggtcatgtccccgcatttccgtgctatccagaagatcatcatgcgcgccttgcgcccgcaattccttgtggccgcaggccatacggagcccgaggtcgatgcgtggtggcaggctcactacaccaccaacgccatcgaggtcgacttcaccgagttcgacatgaaccagaccctcgctactcgggacgtcgagctcgagattagcgccgctctcttgggcctcccctgcgccgaagactaccgtgcactccgcgctggcagctactgcaccctgcgcgaactgggtaccactgagaccggctgcgagcgcacaagcggcgagcccgccacgctgctgcacaacaccaccgtggccatgtgcatggctatgcgcatggtccccaaaggcgtgcgctgggccgggattttccagggcgacgacatggtcatcttcctccctgagggcgcgcgcagcgcggcacttaagtggacccccgccgaggtgggcttgtttggcttccacatcccggtgaagcatgtgagcacccctacccccagtttctgcgggcacgtcggcaccgcggccggcctcttccatgatgtcatgcaccaggcgatcaaggtgctctgccgccgtttcgacccagacgtgcttgaagaacagcaggtggccctcctcgaccgcctccggggggtctacgcggccctgcctgacaccgttgccgccaatgccgcgtactacgactacagcgccgagcgcgtcctcgccattgtgcgcgaacttaccgcgtacgcgcgggggcgcggcctcgaccacccggccaccatcggcgcgctcgaggagatccagaccccctacgcgcgcgccaatctccacgacgccgactaacgcccctgtacgtggggcctttaatcttacctactctaaccaggtcatcacccaccgttgtttcgccgcatctggtgggtaccccactcttgccattcgggagagccccagggtgcccgaatggcttctactacccccatcaccatggaggacctccagaaggccctcgaggcacaatcccgcgccctgcgtgcggaactcgccgccggcgcctcgcagacgcgccggccgcggccgccgcgacagcgcgactccagcacctccggagacgactccggccgtgactccggagggccccgccgccgccgcggcaaccggggccgtggccagcgcagggactggtctagggccccgccccccccggaagagcggcaagaaagccgctcccagactccggccccgaagccatcgcgggcgccgccacaacagcctcaacccccgcgtatgcaaaccgggcgtgggggctctgccccgcgccccgagctggggccaccgaccaacccgttccaagcagccgtagcgcgtggcctgcgcccgcctctccacgatcctgacaccgaggcacccaccgaggcctgcgtaacctcatggctttggagcgaaggtgaaggcgcggtcttttaccgcgtcgatttacactttaccaacctgggcacccccccactcgacgaggacggccgctgggaccctgcgctcatgtacaacccttgcgggcccgagccgcccgctcacgtcgtccgtgcatacaatcaacctgccggcgacgtcaggggcgtttggggtaaaggtgagcgcacttacgctgagcaggatttccgcgttggcggcacgcgctggcaccgactgctgcgcatgccagtgcgcggcctcgacggcgacagcgccccgctacccccccacaccaccgaacgcatcgagacccgctcggcgcgccatccctggcgcatccgtttcggcgctccccaggccttccttgccgggctcttgctcgccgcggtcgccgtaggcaccgcgcgcgccgggctccagccccgcgctgacatggcggcacccccagtgccgccgcagcccccccgtgcgcacgggcagcattacggccatcaccaccatcagctgccgttcctcgggcacgacggccatcacggcggcaccttgcgtgtcggccagcatcaccgaaacgccagcgacgtgctgcccggccactggctccagggtggctggggttgctacaacctgagcgactggcaccagggcactcatgtctgtcacaccaagcacatggacttctggtgtgtggagcacgaccgaccgccgcccgcgactccgacgcctctcaccaccgcggcgaatgccacaaccgccgccacccccgccaccgccccggccccctgccacgccggcctcaatgacagctgcggcggcttcctgtcagggtgcgggccgatgcgcctgcgccacggcgccgacacccggtgcggtcggttgatctgcgggctgtccaccaccgcccagtacccgcctacccggttcggctgcgccatgcggtggggccttcccccctgggaattggtcgttctcaccgcccgccctgaagacggctggacctgccgcggcgtgcccgcccacccaggcacccgctgccccgaactggtgagccccatgggacgcgcgacttgctccccggcctcggcgctctggctcgccacagcgaacgcgctgtctcttgatcacgccctcgcggccttcgtcctgctggtcccgtgggtcctgatattcatggtgtgccgccgcgcctgccgccgccgcggcgccgccgccgcccttaccgcggtcgtcctgcaggggtacaacccccccgcctacggcgaggaggctttcacctacctctgtactgcaccggggtgcgccactcaaacacctgtccccgtgcgcctcgctggcgtccgctttgagtccaagatcgtggacggtggctgctttgccccatgggacctcgaggccactggagcctgcatttgcgagatccccaccgacgtctcgtgcgagggcttgggggcctgggtacccacagccccttgcgcgcgcatctggaacggcacacagcgcgcatgcaccttttgggctgtcaatgcctactcctctggtgggtacgcgcagctggcctcttacttcaaccctggcggcagctactacaagcagtaccaccctaccgcgtgcgaggttgaacctgccttcggccacagcgacgcggcctgctggggcttccccaccgacaccgtgatgagcgtgttcgcccttgccagctacgtccagcaccctcacaagaccgtccgggtcaagttccatacagagaccaggaccgtctggcagctctccgttgccggcgtgtcgtgcaacgtcaccaccgaacacccgttctgcaacacgccgcacggacaactcgaggtccaggtcccgcccgaccccggagacctggttgagtacatcatgaattacaccggcaatcagcagtcccggtggggcctcgggagcccgaattgccatggccccgattgggcctccccggtttgtcaacgccattcccctgactgctcgcggcttgtgggggccacgccagagcgtccccggctgcgcctggttgatgctgacgaccccctgctgcgcactgcccctgggcccggcgaggtgtgggtcacgcccgtcataggctctcaggcgcgcaagtgcggactccacatacgcgccgggccgtacggccatgccaccgtcgaaatgcccgagtggatccacgctcacaccaccagcgacccctggcacccaccgggccccttggggctcaagtttaagacagttcgcccggttgcgctaccacgcgcgttagcgccaccccgcaatgtgcgtgtgaccgggtgctaccagtgcggtacccccgcgctggtggaaggccttgcccccggggggggcaattgccatctcaccgtcaatggcgaggacgtcggcgccttcccccctgggaagttcgttaccgccgccctcctcaacacccccccgccctaccaagtcagctgcgggggcgagagcgatcgcgcgagcgcgcgggttattgaccccgccgcgcaatcgttcaccggcgtggtgtatggcacacacaccactgctgtgtcggagacccggcagacctgggcggagtgggctgccgcccattggtggcagctcactctgggcgctatttgcaccctcctactcgctggcttactcgcttgctgtgccaaatgcttgtactacttgcgcggcgctatagcgccgcgctagtgggcccccgcgcgaaacccgcattagcccactggattcccgcacctgttgctgcatagaaaaaaaaaaaaaaaaaaagaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgcc

SEQ ID NO: 67 - DNA, 40 bp, Artificial Sequence
  717Forward Primer
cggccagtccaagcttagccatactctttatgcccccggt

SEQ ID NO: 68 - DNA, 40 bp, Artificial Sequence
  1005Forward Primer
ttgccccgccaagcttagccatactctttatgcccccggt

SEQ ID NO: 69 - DNA, 35 bp, Artificial Sequence
  717Reverse Primer
acgtggccgcaagcttgcccgcgtaatctgggacg

SEQ ID NO: 70 - DNA, 34 bp, Artificial Sequence
  1005Reverse Primer
ccgggtcgccaagcttgcccgcgtaatctgggac

SEQ ID NO: 71 - DNA, 11261 bp, Artificial Sequence
  wt P150 r4
actagtatttaggtgacactatagcaatgggagctaacggacctcgcttaggactcctattcccatggagaaactcctagatgaggttcttgcccccggtgggccttataacttaaccgtcggcagttgggtaagagaccatgtccgctcaattgtcgagggcgcgtgggaagtgcgcgatgtcgtcaccgctgcccaaaagcgggccatcgtagctgtgatacccagacctgtattcacgcagatgcaggttagtgatcacccagcactccacgcaatttcgcggtatacccgccgccattggatcgagtggggccctaaagaagccctacacgtcctcatcgacccgagcccgggcctgctccgcgaggtcgctcgcgttgagcgccgctgggtcgcactgtgcctccacaggacggcacgcaaactcgccaccgccctggccgagacggccggcgaggcgtggcatgccgactacgtgtgcgcgctgcgtggcgcaccgagcggccccttctacgtccaccctgaggacgtcccgcacggcggccgcgccgtggcggacagatgcttgctctactacacacccatgcagatgtgcgagctgatgcgtgccattgacgccaccttgctcgtggcggttgacttgtggccggtcgcccttgcggctcatgtcggcgacgactgggacgacctgggcatcgcctggcacctcgaccatgacggcggctgccccgccgactgccgcggagccggcgctgggcccacgcccggctacacccgcccctgcaccacacgcatctaccaagtcctgccggacaccgcccaccccgggcgcctctaccggtgcgggccccgcctgtggacgcgcgattgcgccgtggccgaactctcatgggaggttgcccagcactgcgggcaccaggcgcgcgtgcgcgccgtgcgatgcaccctccccatccgccacgtgcgcagcctccaacccagcgcacgggtccgactcccggacctcgtccatctcgccgaggtgggccggtggcggtggttcagcctcccccgccccgtgttccagcgcatgctgtcctactgcaagaccctgagccccgacgcgtactacagcgagcgtgtgttcaagttcaagaacgccctgagccacagcatcacgctcgcgggcaatgtgctgcaagaggggtggaagggcacgtgcgccgaggaagacgcgctgtgcgcatacgtagccttccgcgcgtggcagtctaacgccaggttggcggggatcatgaaaggcgctaagcgctgcgctgccgactctttgagcgtggccggctggctggacaccatttgggacgccatcaagcggttcttcggcagcgtgcccctcgccgagcgcatggaggagtgggaacaggacgccgcggtcgccgccttcgaccgcggcccccttgaggacggcgggcgccacttggacaccgtgcaacccccgaagtcgccgccccgccctgagatcgccgcgacctggatcgtccacgcagccagcgcagaccgccattgcgcgtgcgctccccgctgcgacgtcccgcgcgaacgtccttccgcgcccgccggcccgcccgatgacgaggcgctcatcccgccgtggctgttcgccgagcgccgtgccctccgctgccgcgagtgggactttgaggctctccgcgcgcgcgccgatacggcggccgcgcccgccccgctggccccacgccctgcgcggtaccccactgtgctctaccgccaccccgcccaccacggcccgtggctcacccttgacgagccgggcgaggctgacgcggccctggtcttatgcgacccgcttggccagccgctccggggccctgaacgccacttcgccgccggcgcgcacatgtgcgcgcaggcgcgcgggctccaggcttttgtccgtgttgtgcctccacccgaacgcccctgggccgacgggggcgccagagcgtgggcaaaattcttccgcggctgcgcctgggcgcagcgcttgctcggcgagccggcagtgatgcacctcccatacaccgatggtgacgtgccacagctgatcgcgctggccttgcgcacgctggcccagcagggggccgccttggcactctcggtgcgagacctgcccgggggtgcagcgttcgacgcgaatgcggttaccgccgcagtgcgcgctggccccggccagtccgcggccacgtcaccgccacccggcgaccccccgccaccgcgccgcgcacggcgatcgcaacggcactcggacgcccgcagcactccgccctccgcgcctgcgcgcgacccgccgccgcccgcccccagcccgcccgcgccaccccgcgcgggtgacctggccccccccattctcgcggggccggcggatcgcgcgcgtgacgccgagctggaggtcgcctgcgaaccgagcggcccccccgcgccaaccaaggcagacccagacagcgacatcgttgaaagttacgcccgcgccgccgggcccgtgcacctccgggtccgtgacatcatggacccaccgcctgggtgcaaggtcgtggtcaacgccgccaacgaggggctgctggccggctctggcgtgtgtggtgccatctttgccaacgccacggcggcccttgctgcagactgccggcgcctcgccccatgccccaccggcgaggcagtggcgacacccggccacggctgcgggtacacccacatcatccacgccgttgccccgcggcgccctcgggaccccgccgccctcgaggagggcgaggcactgctcgagcgcgcctaccgcagcatcgtcgcgctagctgctgcgcgtaggtggacgtgtatcgcgtgccccctcctcggcgctggcgtctacggctggtctgctgcggagtccctccgcgccgcgcttgcggccacgcgcgccgagcccgccgagcgcgtgagcctgcacatctgccaccccgaccgcgccacgctgacgcacgcctccgtgctcgttggcgcggggctcgctgccaggcgcgtcagcccccctccggccgagcccctcgcatcttgccccgccggcgacccgggccggccggctcagcgcagcgcgtcgcccccagcgaaaccccttggggatgccgccgcgcccgagccccgcggatgccaggggtgcgaactctgccggtacacgcgcgtcactaatgaccgcgcctatgtcaacctgtggctcgagcgcgaccgcggcgccaccagctgggcgatgcgcattcccgaggtggttgtctacgggccggagcacctcgccacgcattttccattgaaccactacagtgtgctcaagcccgcggaggtcaggcccccgcgaggcatgtgcgggagtgacatgtggcgctgccgcggctggcagggcatgccgcaggtgcggtgcaccccctccaacgcccacgccgccctgtgccgcacaggcgtaccccctcgagtgagcacgcgaggcggcgagctagacccaaacacctgctggctccgcgccgccgccaacgttgcgcaggctgcgcgcgcctgcggcgcctacacgagcgccgggtgccccaagtgcgcctacggccgcgccttgagcgaagcccgcactcatgaggactttgccgccctgagccagcggtggagcgcgagccacgccgatgcctcccctgacggcaccggagatcccctcgaccccctgatggagaccgtgggatgcgcctgttcgcgcgtgtgggtcggctccgagcacgaggccccgcccgaccacctcctggtgtccctccaccgcgcccccaatggtccgtggggcgtagtgctcgaggtgcgcgcgcgccccgaagggggcaaccccaccggccacttcgtttgcgcggtcggcggcggcccacgccgcgtctcggaccgcccccatctttggctcgcggtccccctgtctcggggcggcggcacctgcgccgtgaccgacgaggggctggcccaggcgtactacgacgatctcgaggtgcgccgcctcggggatgacgccatggcccgggcggccctcgcatcagtccaacgccctcgcaaaggcccctacaatattagggtatggaacatggccgcaggcgctggcaagactacccgcatcctcgctgccttcacgcgcgaagacctctacgtctgccccaccaatgcgctcctgcacgagattcaggccaaactccgcgcgcgcgacatcgacatcaagaacgccgccacctacgagcgcgcgctcacgaaaccgctcgccgcctaccgccgcatctacattgatgaggcgttcaccctcggcggcgagtactgcgcgttcgttgccagccaaaccacagcggaggtgatctgcgtcggtgaccgagaccagtgcggcccacactacgccaacaactgccgcacccctgtccccgaccgctggcctaccgagcgctcacgccacacttggcgcttccccgactgctgggccgcccgcctgcgcgcggggctcgattatgacatcgagggcgagcgcatcggcaccttcgcctgcaacctttgggacggccgccaggtcgaccttcacctcgccttctcgcgcgaaaccgtgcgccgccttcacgaggctggcatacgcgcatacaccgtgcgcgaggcccagggcatgagcgtcggcaccgcctgcatccatgtaggcagggacggcacggacgttgccctggcgctgacacgcgaccttgccatcgtcagcctgacccgggcctccgacgcgctctacctccacgagctcgaggacggctcactgcgcgctgcggggctcagcgcgttcctcgacgccggggcactggcggagctcaaggaggttcccgctggcatcgaccgcgttgtcgccgtcgaacaggcaccaccaccgttgccgcccgccgacggcatccccgaggcccaagacgtgccacccttctgtccccgcactctggaggagctcgtcttcggccgtgccggccacccccattacgcggacctcaaccgcgtgaccgagggcgaacgggaagtgcggtatatgcgcatctcgcgccacctgctcaacaagaatcataccgagatgcctgggacggaacgcgtcctcagtgccgtttgcgccgtgcggcgctaccgcgcgggcgaggatgggtcgaccctccgcactgctgtggcccgccagcacccgcgccctttccgccagatcccacccccgcgcgtcactgctggggtcgcccaggagtggcgcatgacatacctgcgggaacggatcgacctcactgatgtctacacgcagatgggcgtggctgcgcgggagctcaccgaccgctacgcgcgccgctaccctgagatcttcgccggcatgtgtaccgcccagagcctgagcgtccccgccttcctcaaagccaccctgaagtgcgtagacgccgccctcggccccagcgacaccgaggactgtcacgccgcccaggggaaagccggccttgaaatccgggcgtgggccaaggagtgggttcaggtcatgtccccgcatttccgtgctatccagaagatcatcatgcgcgccttgcgcccgcaattccttgtggccgcaggccatacggagcccgaggtcgatgcgtggtggcaggctcactacaccaccaacgccatcgaggtcgacttcaccgagttcgacatgaaccagaccctcgctactcgggacgtcgagctcgagattagcgccgctctcttgggcctcccctgcgccgaagactaccgtgcactccgcgctggcagctactgcaccctgcgcgaactgggtaccactgagaccggctgcgagcgcacaagcggcgagcccgccacgctgctgcacaacaccaccgtggccatgtgcatggctatgcgcatggtccccaaaggcgtgcgctgggccgggattttccagggcgacgacatggtcatcttcctccctgagggcgcgcgcagcgcggcacttaagtggacccccgccgaggtgggcttgtttggcttccacatcccggtgaagcatgtgagcacccctacccccagtttctgcgggcacgtcggcaccgcggccggcctcttccatgatgtcatgcaccaggcgatcaaggtgctctgccgccgtttcgacccagacgtgcttgaagaacagcaggtggccctcctcgaccgcctccggggggtctacgcggccctgcctgacaccgttgccgccaatgccgcgtactacgactacagcgccgagcgcgtcctcgccattgtgcgcgaacttaccgcgtacgcgcgggggcgcggcctcgaccacccggccaccatcggcgcgctcgaggagatccagaccccctacgcgcgcgccaatctccacgacgccgactaacgcccctgtacgtggggcctttaatcttacctactctaaccaggtcatcacccaccgttgtttcgccgcatctggtgggtaccccactcttgccattcgggagagccccagggtgcccgaatgggatccatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgtaatctagacgcccctctcccccccccccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacaaggagacgaccttccatgaccgagtacaagcccacggtgcgcctcgccacccgcgacgacgtcccccgggccgtacgcaccctcgccgccgcgttcgccgactaccccgccacgcgccacaccgtcgacccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgaatcgatagtcagctgcgggggcgagagcgatcgcgcgagcgcgcgggttattgaccccgccgcgcaatcgttcaccggcgtggtgtatggcacacacaccactgctgtgtcggagacccggcagacctgggcggagtgggctgccgcccattggtggcagctcactctgggcgctatttgcaccctcctactcgctggcttactcgcttgctgtgccaaatgcttgtactacttgcgcggcgctatagcgccgcgctagtgggcccccgcgcgaaacccgcattagcccactggattcccgcacctgttgctgcatagaaaaaaaaaaaaaaaaaaagaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgcc

SEQ ID NO: 72 - DNA, 12287 bp, Artificial Sequence
  P150-717pmag-nMaghigh
actagtatttaggtgacactatagcaatgggagctaacggacctcgcttaggactcctattcccatggagaaactcctagatgaggttcttgcccccggtgggccttataacttaaccgtcggcagttgggtaagagaccatgtccgctcaattgtcgagggcgcgtgggaagtgcgcgatgtcgtcaccgctgcccaaaagcgggccatcgtagctgtgatacccagacctgtattcacgcagatgcaggttagtgatcacccagcactccacgcaatttcgcggtatacccgccgccattggatcgagtggggccctaaagaagccctacacgtcctcatcgacccgagcccgggcctgctccgcgaggtcgctcgcgttgagcgccgctgggtcgcactgtgcctccacaggacggcacgcaaactcgccaccgccctggccgagacggccggcgaggcgtggcatgccgactacgtgtgcgcgctgcgtggcgcaccgagcggccccttctacgtccaccctgaggacgtcccgcacggcggccgcgccgtggcggacagatgcttgctctactacacacccatgcagatgtgcgagctgatgcgtgccattgacgccaccttgctcgtggcggttgacttgtggccggtcgcccttgcggctcatgtcggcgacgactgggacgacctgggcatcgcctggcacctcgaccatgacggcggctgccccgccgactgccgcggagccggcgctgggcccacgcccggctacacccgcccctgcaccacacgcatctaccaagtcctgccggacaccgcccaccccgggcgcctctaccggtgcgggccccgcctgtggacgcgcgattgcgccgtggccgaactctcatgggaggttgcccagcactgcgggcaccaggcgcgcgtgcgcgccgtgcgatgcaccctccccatccgccacgtgcgcagcctccaacccagcgcacgggtccgactcccggacctcgtccatctcgccgaggtgggccggtggcggtggttcagcctcccccgccccgtgttccagcgcatgctgtcctactgcaagaccctgagccccgacgcgtactacagcgagcgtgtgttcaagttcaagaacgccctgagccacagcatcacgctcgcgggcaatgtgctgcaagaggggtggaagggcacgtgcgccgaggaagacgcgctgtgcgcatacgtagccttccgcgcgtggcagtctaacgccaggttggcggggatcatgaaaggcgctaagcgctgcgctgccgactctttgagcgtggccggctggctggacaccatttgggacgccatcaagcggttcttcggcagcgtgcccctcgccgagcgcatggaggagtgggaacaggacgccgcggtcgccgccttcgaccgcggcccccttgaggacggcgggcgccacttggacaccgtgcaacccccgaagtcgccgccccgccctgagatcgccgcgacctggatcgtccacgcagccagcgcagaccgccattgcgcgtgcgctccccgctgcgacgtcccgcgcgaacgtccttccgcgcccgccggcccgcccgatgacgaggcgctcatcccgccgtggctgttcgccgagcgccgtgccctccgctgccgcgagtgggactttgaggctctccgcgcgcgcgccgatacggcggccgcgcccgccccgctggccccacgccctgcgcggtaccccactgtgctctaccgccaccccgcccaccacggcccgtggctcacccttgacgagccgggcgaggctgacgcggccctggtcttatgcgacccgcttggccagccgctccggggccctgaacgccacttcgccgccggcgcgcacatgtgcgcgcaggcgcgcgggctccaggcttttgtccgtgttgtgcctccacccgaacgcccctgggccgacgggggcgccagagcgtgggcaaaattcttccgcggctgcgcctgggcgcagcgcttgctcggcgagccggcagtgatgcacctcccatacaccgatggtgacgtgccacagctgatcgcgctggccttgcgcacgctggcccagcagggggccgccttggcactctcggtgcgagacctgcccgggggtgcagcgttcgacgcgaatgcggttaccgccgcagtgcgcgctggccccggccagtccaagcttagccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaaaccggtaattccgctgacggcggcggaggatcgggtggtagtggtggttcaggaggaggatcgacccaaggaggatccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatccgcaaggcaatcgacaggaatgccgaggtgcaggttgaagtagtcaattttaaaaagaatggacagcgatttgttaatttcctgactatcatacctgttagggacgaaacaggcgagtatcgatactctatgggattccagtgcgaaacagaatatccgtacgacgtcccagattacgcgggcaagcttgcggccacgtcaccgccacccggcgaccccccgccaccgcgccgcgcacggcgatcgcaacggcactcggacgcccgcagcactccgccctccgcgcctgcgcgcgacccgccgccgcccgcccccagcccgcccgcgccaccccgcgcgggtgacctggccccccccattctcgcggggccggcggatcgcgcgcgtgacgccgagctggaggtcgcctgcgaaccgagcggcccccccgcgccaaccaaggcagacccagacagcgacatcgttgaaagttacgcccgcgccgccgggcccgtgcacctccgggtccgtgacatcatggacccaccgcctgggtgcaaggtcgtggtcaacgccgccaacgaggggctgctggccggctttggcgtgtgtggtgccatctttgccaacgccacggcggcccttgctgcagactgccggcgcctcgccccatgccccaccggcgaggcagtggcgacacccggccacggctgcgggtacacccacatcatccacgccgttgccccgcggcgccctcgggaccccgccgccctcgaggagggcgaggcactgctcgagcgcgcctaccgcagcatcgtcgcgctagctgctgcgcgtaggtggacgtgtatcgcgtgccccctcctcggcgctggcgtctacggctggtctgctgcggagtccctccgcgccgcgcttgcggccacgcgcgccgagcccgccgagcgcgtgagcctgcacatctgccaccccgaccgcgccacgctgacgcacgcctccgtgctcgttggcgcggggctcgctgccaggcgcgtcagcccccctccggccgagcccctcgcatcttgccccgccggcgacccgggccggccggctcagcgcagcgcgtcgcccccagcgaaaccccttggggatgccgccgcgcccgagccccgcggatgccaggggtgcgaactctgccggtacacgcgcgtcactaatgaccgcgcctatgtcaacctgtggctcgagcgcgaccgcggcgccaccagctgggcgatgcgcattcccgaggtggttgtctacgggccggagcacctcgccacgcattttccattgaaccactacagtgtgctcaagcccgcggaggtcaggcccccgcgaggcatgtgcgggagtgacatgtggcgctgccgcggctggcagggcatgccgcaggtgcggtgcaccccctccaacgcccacgccgccctgtgccgcacaggcgtaccccctcgagtgagcacgcgaggcggcgagctagacccaaacacctgctggctccgcgccgccgccaacgttgcgcaggctgcgcgcgcctgcggcgcctacacgagcgccgggtgccccaagtgcgcctacggccgcgccttgagcgaagcccgcactcatgaggactttgccgccctgagccagcggtggagcgcgagccacgccgatgcctcccctgacggcaccggagatcccctcgaccccctgatggagaccgtgggatgcgcctgttcgcgcgtgtgggtcggctccgagcacgaggccccgcccgaccacctcctggtgtccctccaccgcgcccccaatggtccgtggggcgtagtgctcgaggtgcgcgcgcgccccgaagggggcaaccccaccggccacttcgtttgcgcggtcggcggcggcccacgccgcgtctcggaccgcccccatctttggctcgcggtccccctgtctcggggcggcggcacctgcgccgtgaccgacgaggggctggcccaggcgtactacgacgatctcgaggtgcgccgcctcggggatgacgccatggcccgggcggccctcgcatcagtccaacgccctcgcaaaggcccctacaatattagggtatggaacatggccgcaggcgctggcaagactacccgcatcctcgctgccttcacgcgcgaagacctctacgtctgccccaccaatgcgctcctgcacgagattcaggccaaactccgcgcgcgcgacatcgacatcaagaacgccgccacctacgagcgcgcgctcacgaaaccgctcgccgcctaccgccgcatctacattgatgaggcgttcaccctcggcggcgagtactgcgcgttcgttgccagccaaaccacagcggaggtgatctgcgtcggtgaccgagaccagtgcggcccacactacgccaacaactgccgcacccctgtccccgaccgctggcctaccgagcgctcacgccacacttggcgcttccccgactgctgggccgcccgcctgcgcgcggggctcgattatgacatcgagggcgagcgcatcggcaccttcgcctgcaacctttgggacggccgccaggtcgaccttcacctcgccttctcgcgcgaaaccgtgcgccgccttcacgaggctggcatacgcgcatacaccgtgcgcgaggcccagggcatgagcgtcggcaccgcctgcatccatgtaggcagggacggcacggacgttgccctggcgctgacacgcgaccttgccatcgtcagcctgacccgggcctccgacgcgctctacctccacgagctcgaggacggctcactgcgcgctgcggggctcagcgcgttcctcgacgccggggcactggcggagctcaaggaggttcccgctggcatcgaccgcgttgtcgccgtcgaacaggcaccaccaccgttgccgcccgccgacggcatccccgaggcccaagacgtgccacccttctgtccccgcactctggaggagctcgtcttcggccgtgccggccacccccattacgcggacctcaaccgcgtgaccgagggcgaacgggaagtgcggtatatgcgcatctcgcgccacctgctcaacaagaatcataccgagatgcctgggacggaacgcgtcctcagtgccgtttgcgccgtgcggcgctaccgcgcgggcgaggatgggtcgaccctccgcactgctgtggcccgccagcacccgcgccctttccgccagatcccacccccgcgcgtcactgctggggtcgcccaggagtggcgcatgacatacctgcgggaacggatcgacctcactgatgtctacacgcagatgggcgtggctgcgcgggagctcaccgaccgctacgcgcgccgctaccctgagatcttcgccggcatgtgtaccgcccagagcctgagcgtccccgccttcctcaaagccaccctgaagtgcgtagacgccgccctcggccccagcgacaccgaggactgtcacgccgcccaggggaaagccggccttgaaatccgggcgtgggccaaggagtgggttcaggtcatgtccccgcatttccgtgctatccagaagatcatcatgcgcgccttgcgcccgcaattccttgtggccgcaggccatacggagcccgaggtcgatgcgtggtggcaggctcactacaccaccaacgccatcgaggtcgacttcaccgagttcgacatgaaccagaccctcgctactcgggacgtcgagctcgagattagcgccgctctcttgggcctcccctgcgccgaagactaccgtgcactccgcgctggcagctactgcaccctgcgcgaactgggtaccactgagaccggctgcgagcgcacaagcggcgagcccgccacgctgctgcacaacaccaccgtggccatgtgcatggctatgcgcatggtccccaaaggcgtgcgctgggccgggattttccagggcgacgacatggtcatcttcctccctgagggcgcgcgcagcgcggcacttaagtggacccccgccgaggtgggcttgtttggcttccacatcccggtgaagcatgtgagcacccctacccccagtttctgcgggcacgtcggcaccgcggccggcctcttccatgatgtcatgcaccaggcgatcaaggtgctctgccgccgtttcgacccagacgtgcttgaagaacagcaggtggccctcctcgaccgcctccggggggtctacgcggccctgcctgacaccgttgccgccaatgccgcgtactacgactacagcgccgagcgcgtcctcgccattgtgcgcgaacttaccgcgtacgcgcgggggcgcggcctcgaccacccggccaccatcggcgcgctcgaggagatccagaccccctacgcgcgcgccaatctccacgacgccgactaacgcccctgtacgtggggcctttaatcttacctactctaaccaggtcatcacccaccgttgtttcgccgcatctggtgggtaccccactcttgccattcgggagagccccagggtgcccgaatgggatccatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgtaatctagacgcccctctcccccccccccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacaaggagacgaccttccatgaccgagtacaagcccacggtgcgcctcgccacccgcgacgacgtcccccgggccgtacgcaccctcgccgccgcgttcgccgactaccccgccacgcgccacaccgtcgacccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgaatcgatagtcagctgcgggggcgagagcgatcgcgcgagcgcgcgggttattgaccccgccgcgcaatcgttcaccggcgtggtgtatggcacacacaccactgctgtgtcggagacccggcagacctgggcggagtgggctgccgcccattggtggcagctcactctgggcgctatttgcaccctcctactcgctggcttactcgcttgctgtgccaaatgcttgtactacttgcgcggcgctatagcgccgcgctagtgggcccccgcgcgaaacccgcattagcccactggattcccgcacctgttgctgcatagaaaaaaaaaaaaaaaaaaagaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgcc

SEQ ID NO: 73 - DNA, 12287 bp, Artificial Sequence
  P150-1005pmag-nMaghigh
actagtatttaggtgacactatagcaatgggagctaacggacctcgcttaggactcctattcccatggagaaactcctagatgaggttcttgcccccggtgggccttataacttaaccgtcggcagttgggtaagagaccatgtccgctcaattgtcgagggcgcgtgggaagtgcgcgatgtcgtcaccgctgcccaaaagcgggccatcgtagctgtgatacccagacctgtattcacgcagatgcaggttagtgatcacccagcactccacgcaatttcgcggtatacccgccgccattggatcgagtggggccctaaagaagccctacacgtcctcatcgacccgagcccgggcctgctccgcgaggtcgctcgcgttgagcgccgctgggtcgcactgtgcctccacaggacggcacgcaaactcgccaccgccctggccgagacggccggcgaggcgtggcatgccgactacgtgtgcgcgctgcgtggcgcaccgagcggccccttctacgtccaccctgaggacgtcccgcacggcggccgcgccgtggcggacagatgcttgctctactacacacccatgcagatgtgcgagctgatgcgtgccattgacgccaccttgctcgtggcggttgacttgtggccggtcgcccttgcggctcatgtcggcgacgactgggacgacctgggcatcgcctggcacctcgaccatgacggcggctgccccgccgactgccgcggagccggcgctgggcccacgcccggctacacccgcccctgcaccacacgcatctaccaagtcctgccggacaccgcccaccccgggcgcctctaccggtgcgggccccgcctgtggacgcgcgattgcgccgtggccgaactctcatgggaggttgcccagcactgcgggcaccaggcgcgcgtgcgcgccgtgcgatgcaccctccccatccgccacgtgcgcagcctccaacccagcgcacgggtccgactcccggacctcgtccatctcgccgaggtgggccggtggcggtggttcagcctcccccgccccgtgttccagcgcatgctgtcctactgcaagaccctgagccccgacgcgtactacagcgagcgtgtgttcaagttcaagaacgccctgagccacagcatcacgctcgcgggcaatgtgctgcaagaggggtggaagggcacgtgcgccgaggaagacgcgctgtgcgcatacgtagccttccgcgcgtggcagtctaacgccaggttggcggggatcatgaaaggcgctaagcgctgcgctgccgactctttgagcgtggccggctggctggacaccatttgggacgccatcaagcggttcttcggcagcgtgcccctcgccgagcgcatggaggagtgggaacaggacgccgcggtcgccgccttcgaccgcggcccccttgaggacggcgggcgccacttggacaccgtgcaacccccgaagtcgccgccccgccctgagatcgccgcgacctggatcgtccacgcagccagcgcagaccgccattgcgcgtgcgctccccgctgcgacgtcccgcgcgaacgtccttccgcgcccgccggcccgcccgatgacgaggcgctcatcccgccgtggctgttcgccgagcgccgtgccctccgctgccgcgagtgggactttgaggctctccgcgcgcgcgccgatacggcggccgcgcccgccccgctggccccacgccctgcgcggtaccccactgtgctctaccgccaccccgcccaccacggcccgtggctcacccttgacgagccgggcgaggctgacgcggccctggtcttatgcgacccgcttggccagccgctccggggccctgaacgccacttcgccgccggcgcgcacatgtgcgcgcaggcgcgcgggctccaggcttttgtccgtgttgtgcctccacccgaacgcccctgggccgacgggggcgccagagcgtgggcaaaattcttccgcggctgcgcctgggcgcagcgcttgctcggcgagccggcagtgatgcacctcccatacaccgatggtgacgtgccacagctgatcgcgctggccttgcgcacgctggcccagcagggggccgccttggcactctcggtgcgagacctgcccgggggtgcagcgttcgacgcgaatgcggttaccgccgcagtgcgcgctggccccggccagtccgcggccacgtcaccgccacccggcgaccccccgccaccgcgccgcgcacggcgatcgcaacggcactcggacgcccgcagcactccgccctccgcgcctgcgcgcgacccgccgccgcccgcccccagcccgcccgcgccaccccgcgcgggtgacctggccccccccattctcgcggggccggcggatcgcgcgcgtgacgccgagctggaggtcgcctgcgaaccgagcggcccccccgcgccaaccaaggcagacccagacagcgacatcgttgaaagttacgcccgcgccgccgggcccgtgcacctccgggtccgtgacatcatggacccaccgcctgggtgcaaggtcgtggtcaacgccgccaacgaggggctgctggccggctttggcgtgtgtggtgccatctttgccaacgccacggcggcccttgctgcagactgccggcgcctcgccccatgccccaccggcgaggcagtggcgacacccggccacggctgcgggtacacccacatcatccacgccgttgccccgcggcgccctcgggaccccgccgccctcgaggagggcgaggcactgctcgagcgcgcctaccgcagcatcgtcgcgctagctgctgcgcgtaggtggacgtgtatcgcgtgccccctcctcggcgctggcgtctacggctggtctgctgcggagtccctccgcgccgcgcttgcggccacgcgcgccgagcccgccgagcgcgtgagcctgcacatctgccaccccgaccgcgccacgctgacgcacgcctccgtgctcgttggcgcggggctcgctgccaggcgcgtcagcccccctccggccgagcccctcgcatcttgccccgccaagcttagccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaaaccggtaattccgctgacggcggcggaggatcgggtggtagtggtggttcaggaggaggatcgacccaaggaggatccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatccgcaaggcaatcgacaggaatgccgaggtgcaggttgaagtagtcaattttaaaaagaatggacagcgatttgttaatttcctgactatcatacctgttagggacgaaacaggcgagtatcgatactctatgggattccagtgcgaaacagaatatccgtacgacgtcccagattacgcgggcaagcttggcgacccgggccggccggctcagcgcagcgcgtcgcccccagcgaaaccccttggggatgccgccgcgcccgagccccgcggatgccaggggtgcgaactctgccggtacacgcgcgtcactaatgaccgcgcctatgtcaacctgtggctcgagcgcgaccgcggcgccaccagctgggcgatgcgcattcccgaggtggttgtctacgggccggagcacctcgccacgcattttccattgaaccactacagtgtgctcaagcccgcggaggtcaggcccccgcgaggcatgtgcgggagtgacatgtggcgctgccgcggctggcagggcatgccgcaggtgcggtgcaccccctccaacgcccacgccgccctgtgccgcacaggcgtaccccctcgagtgagcacgcgaggcggcgagctagacccaaacacctgctggctccgcgccgccgccaacgttgcgcaggctgcgcgcgcctgcggcgcctacacgagcgccgggtgccccaagtgcgcctacggccgcgccttgagcgaagcccgcactcatgaggactttgccgccctgagccagcggtggagcgcgagccacgccgatgcctcccctgacggcaccggagatcccctcgaccccctgatggagaccgtgggatgcgcctgttcgcgcgtgtgggtcggctccgagcacgaggccccgcccgaccacctcctggtgtccctccaccgcgcccccaatggtccgtggggcgtagtgctcgaggtgcgcgcgcgccccgaagggggcaaccccaccggccacttcgtttgcgcggtcggcggcggcccacgccgcgtctcggaccgcccccatctttggctcgcggtccccctgtctcggggcggcggcacctgcgccgtgaccgacgaggggctggcccaggcgtactacgacgatctcgaggtgcgccgcctcggggatgacgccatggcccgggcggccctcgcatcagtccaacgccctcgcaaaggcccctacaatattagggtatggaacatggccgcaggcgctggcaagactacccgcatcctcgctgccttcacgcgcgaagacctctacgtctgccccaccaatgcgctcctgcacgagattcaggccaaactccgcgcgcgcgacatcgacatcaagaacgccgccacctacgagcgcgcgctcacgaaaccgctcgccgcctaccgccgcatctacattgatgaggcgttcaccctcggcggcgagtactgcgcgttcgttgccagccaaaccacagcggaggtgatctgcgtcggtgaccgagaccagtgcggcccacactacgccaacaactgccgcacccctgtccccgaccgctggcctaccgagcgctcacgccacacttggcgcttccccgactgctgggccgcccgcctgcgcgcggggctcgattatgacatcgagggcgagcgcatcggcaccttcgcctgcaacctttgggacggccgccaggtcgaccttcacctcgccttctcgcgcgaaaccgtgcgccgccttcacgaggctggcatacgcgcatacaccgtgcgcgaggcccagggcatgagcgtcggcaccgcctgcatccatgtaggcagggacggcacggacgttgccctggcgctgacacgcgaccttgccatcgtcagcctgacccgggcctccgacgcgctctacctccacgagctcgaggacggctcactgcgcgctgcggggctcagcgcgttcctcgacgccggggcactggcggagctcaaggaggttcccgctggcatcgaccgcgttgtcgccgtcgaacaggcaccaccaccgttgccgcccgccgacggcatccccgaggcccaagacgtgccacccttctgtccccgcactctggaggagctcgtcttcggccgtgccggccacccccattacgcggacctcaaccgcgtgaccgagggcgaacgggaagtgcggtatatgcgcatctcgcgccacctgctcaacaagaatcataccgagatgcctgggacggaacgcgtcctcagtgccgtttgcgccgtgcggcgctaccgcgcgggcgaggatgggtcgaccctccgcactgctgtggcccgccagcacccgcgccctttccgccagatcccacccccgcgcgtcactgctggggtcgcccaggagtggcgcatgacatacctgcgggaacggatcgacctcactgatgtctacacgcagatgggcgtggctgcgcgggagctcaccgaccgctacgcgcgccgctaccctgagatcttcgccggcatgtgtaccgcccagagcctgagcgtccccgccttcctcaaagccaccctgaagtgcgtagacgccgccctcggccccagcgacaccgaggactgtcacgccgcccaggggaaagccggccttgaaatccgggcgtgggccaaggagtgggttcaggtcatgtccccgcatttccgtgctatccagaagatcatcatgcgcgccttgcgcccgcaattccttgtggccgcaggccatacggagcccgaggtcgatgcgtggtggcaggctcactacaccaccaacgccatcgaggtcgacttcaccgagttcgacatgaaccagaccctcgctactcgggacgtcgagctcgagattagcgccgctctcttgggcctcccctgcgccgaagactaccgtgcactccgcgctggcagctactgcaccctgcgcgaactgggtaccactgagaccggctgcgagcgcacaagcggcgagcccgccacgctgctgcacaacaccaccgtggccatgtgcatggctatgcgcatggtccccaaaggcgtgcgctgggccgggattttccagggcgacgacatggtcatcttcctccctgagggcgcgcgcagcgcggcacttaagtggacccccgccgaggtgggcttgtttggcttccacatcccggtgaagcatgtgagcacccctacccccagtttctgcgggcacgtcggcaccgcggccggcctcttccatgatgtcatgcaccaggcgatcaaggtgctctgccgccgtttcgacccagacgtgcttgaagaacagcaggtggccctcctcgaccgcctccggggggtctacgcggccctgcctgacaccgttgccgccaatgccgcgtactacgactacagcgccgagcgcgtcctcgccattgtgcgcgaacttaccgcgtacgcgcgggggcgcggcctcgaccacccggccaccatcggcgcgctcgaggagatccagaccccctacgcgcgcgccaatctccacgacgccgactaacgcccctgtacgtggggcctttaatcttacctactctaaccaggtcatcacccaccgttgtttcgccgcatctggtgggtaccccactcttgccattcgggagagccccagggtgcccgaatgggatccatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgtaatctagacgcccctctcccccccccccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacaaggagacgaccttccatgaccgagtacaagcccacggtgcgcctcgccacccgcgacgacgtcccccgggccgtacgcaccctcgccgccgcgttcgccgactaccccgccacgcgccacaccgtcgacccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgaatcgatagtcagctgcgggggcgagagcgatcgcgcgagcgcgcgggttattgaccccgccgcgcaatcgttcaccggcgtggtgtatggcacacacaccactgctgtgtcggagacccggcagacctgggcggagtgggctgccgcccattggtggcagctcactctgggcgctatttgcaccctcctactcgctggcttactcgcttgctgtgccaaatgcttgtactacttgcgcggcgctatagcgccgcgctagtgggcccccgcgcgaaacccgcattagcccactggattcccgcacctgttgctgcatagaaaaaaaaaaaaaaaaaaagaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgcc

SEQ ID NO: 74 - DNA, 16356 bp, Artificial Sequence
  Ln-pmag plasmid
accaaacaaagttgggtaaggatagatcaatcaatgatcatattctagtacacttaggattcaagatcctattatcagggacaagagcaggattagggatatccgagatggccacacttttgaggagcttagcattgttcaaaagaaacaaggacaaaccacccattacatcaggatccggtggagccatcagaggaatcaaacacattattatagtaccaattcctggagattcctcaattaccactcgatccagactactggaccggttggtcaggttaattggaaacccggatgtgagcgggcccaaactaacaggggcactaataggtatattatccttatttgtggagtctccaggtcaattgattcagaggatcaccgatgaccctgacgttagcatcaggctgttagaggttgttcagagtgaccagtcacaatctggccttaccttcgcatcaagaggtaccaacatggaggatgaggcggaccaatacttttcacatgatgatccaagcagtagtgatcaatccaggtccggatggttcgagaacaaggaaatctcagatattgaagtgcaagaccctgagggattcaacatgattctgggtaccattctagcccagatctgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctctttacgccgattcatggtggctctaatcctggatatcaagaggacacccgggaacaaacctaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaatctttaccagcaaatgggagaaactgcaccctacatggtaatcctagagaactcaattcagaacaagttcagtgcaggatcataccctctgctctggagctatgccatgggagtaggagtggaacttgaaaactccatgggaggtttgaactttggtcgatcttactttgatccagcatattttagattagggcaagagatggtgaggaggtcagctggaaaggtcagttccacattggcatccgaactcggtatcactgccgaggatgcaaggcttgtttcagagattgcaatgcatactactgaggacaggatcagtagagcggtcggacccagacaagcccaagtgtcatttctacacggtgatcaaagtgagaatgagctaccaggattggggggcaaggaagataggagggtcaaacagggtcggggagaagccagggagagctacagagaaaccgggtccagcagagcaagtgatgcgagagctgcccatcctccaaccagcatgcccctagacattgacactgcatcggagtcaggccaagatccgcaggacagtcgaaggtcagctgacgccctgctcaggctgcaagccatggcaggaatcttggaagaacaaggctcagacacggacacccctagggtatacaatgacagagatcttctagactaggtgcgagaggccgaggaccagaacaacatccgcctaccctccatcattgttataaaaaacttaggaaccaggtccacacagccgccagccaaccaaccatccactcccacgactggagccgatggcagaagagcaggcacgccatgtcaaaaacggactggaatgcatccgggctctcaaggccgagcccatcggctcactggccgtcgaggaagccatggcagcatggtcagaaatatcagacaacccaggacaggaccgagccacctgcaaggaagaggaggcaggcagttcgggtctcagcaaaccatgcctctcagcaattggatcaactgaaggcggtgcacctcgcatccgcggtcagggatctggagaaagcgatgacgacgctgaaactttgggaatcccctcaagaaatctccaggcatcaagcactgggttacagtgttatcatgtttatgatcacagcggtgaagcggttaagggaatccaagatgctgactctatcatggttcaatcaggccttgatggtgatagcaccctctcaggaggagacgatgaatctgaaaacagcgatgtggatattggcgaacctgataccgagggatatgctatcactgaccggggatctgctcccatctctatggggttcagggcttctgatgttgaaactgcagaaggaggggagatccacgagctcctgaaactccaatccagaggcaacaactttccgaagcttgggaaaactctcaatgttcctccgcccccgaaccccagtagggccagcacttccgagacacccattaaaaagggcacagacgcgagattggcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctccgatgtccaagacatcaaaacagccttggccaaaatacacgaggataatcagaagataatctccaagctagaatcattgctgttattgaagggagaagttgagtcaattaagaagcagatcaacaggcaaaatatcagcatatccaccctggaaggacacctctcaagcatcatgattgccattcctggacttgggaaggatcccaacgaccccactgcagatgtcgaactcaatcccgacctgaaacccatcataggcagagattcaggccgagcactggccgaagttctcaagaagcccgttgccagccgacaactccagggaatgactaatggacggaccagttccagaggacagctgctgaaggaatttcaactaaagccgatcgggaaaaaggtgagctcagccgtcgggtttgttcctgacaccggccctgcatcacgcagtgtaatccgctccattataaaatccagccggctagaggaggatcggaagcgttacctgatgactctccttgatgatatcaaaggagccaacgatcttgccaagttccaccagatgctgatgaagataataatgaagtagctacagctcaacttacctgccaaccccatgccagtcgacctaattagtacaacctaaatccattataaaaaacttaggagcaaagtgattgcctcctaagttccacaatgacagagatctacgatttcgacaagtcggcatgggacatcaaagggtcgatcgctccgatacaacctaccacctacagtgatggcaggctggtgccccaggtcagagtcatagatcctggtctaggtgataggaaggatgaatgctttatgtacatgtttctgctgggggttgttgaggacagcgatcccctagggcctccaatcgggcgagcattcgggtccctgcccttaggtgttggtagatccacagcaaaacccgaggaactcctcaaagaggccactgagcttgacatagttgttagacgtacagcagggctcaatgaaaaactggtgttctacaacaacaccccactaaccctcctcacaccttggagaaaggtcctaacaacagggagtgtcttcaatgcaaaccaagtgtgcaatgcggttaatctaataccgctggacaccccgcagaggttccgtgttgtttatatgagcatcacccgtctttcggataacgggtattacaccgttcccagaagaatgctggaattcagatcggtcaatgcagtggccttcaacctgctagtgacccttaggattgacaaggcgattggccctgggaagatcatcgacaatgcagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccactgatggatatcaatgaagaccttaatcggttactctggaggagcagatgcaagatagtaagaatccaggcagttttgcagccatcagttcctcaagaattccgcatttacgacgacgtgatcataaatgatgaccaaggactattcaaagttctgtagaccgcagtgcccagcaatacccgaaaacgacccccctcataatgacagccagaaggcccggacaaaaaagccccctccagaagactccacggaccaagcgagaggccagccagcagccgacagcaagtgtggacaccaggcggcccaagcacagaacagccccgacacaaggccaccaccagccatcccaatctgcgtcctcctcgtgggacccccgaggaccaaccccgaaggtcgctccgaacacagaccaccaaccgcatccccacagctcccgggaaaggaacccccagcaactggaaggcccctccccccctcccccaacgcaagaaccccacaaccgaaccgcacaagcgaccgaggtgacccaaccgcaggcatccgactccttagacagatcctctccccccggcatactaaacaaaacttagggccaaggaacacacacactcgacagaacccagaccccggcccgcggcaccgcgcccccaccccccgaaaaccagagggagcccccaaccaaacccgccggcccccccggtgcccacaggtaggcacaccaacccccgaccagacccagcacccagccaccgacaatccaagacggggggccccccccaaaaaaaggcccccaggggccgacagccagcatcgcgaggaagcacacccaccccacacacgaccacggcaaccgaaccagagtccagaccaccctgggccaccagctcccagactcggccatcaccccgcaaaaaggaaaggccacaacccgcgcaccccagccccgatccggcgggcagccactcaacccgaaccagcacccaagagcgatccctgggggacccccaaaccgcaaaagacatcagtatcccacagcctctccaagtcccccggtctcctcctcttctcgaagggaccaaaagatcaatccaccacatccgacgacactcaattccccacccccaaaggagacaccgggaatcccagaatcaagactcatccagtgtccatcatgggtctcaaggtgaacgtctctgccatattcatggcagtactgttaactctccaaacacccaccggtcaaatccattggggcaatctctctaagataggggtggtagggataggaagtgcaagctacaaagttatgactcgttccagccatcaatcattggtcataaaattaatgcccaatataactctcctcaataactgcacgagggtagagatcgcagaatacaggagactactgagaacagttttggaaccaattagagatgcacttaatgcaatgacccagaatataagaccggttcagagtgtagcttcaagtaggagacacaagagatttgcgggagttgtcctggcaggtgcggccctaggcgttgccacagctgctcagataacagccggcattgcacttcaccagtccatgctgaactctcaagccatcgacaatctgagagcaagcctggaaactactaatcaggcaattgaggcaatcagacaagcagggcaggagatgatattggctgttcagggtgtccaagactacatcaataatgagctgataccgtctatgaaccaactatcttgtgatttaatcggccagaagctagggctcaaattgctcagatactatacagaaatcctgtcattatttggccccagcttacgggaccccatatctgcggagatatccatccaggctttgagctatgcgcttggaggagatatcaataaggtattagaaaagctcggatacagtggaggtgatttactgggcatcttagagagcagaggaataaaggcccggataactcacgtcgacacagagtcctacttcattgtactcagtatagcctatccgacgctgtccgagattaagggggtgattgtccaccggctagagggggtctcgtacaatataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtccaccaagtcctgtgctcgtacactcgtatccgggtcttttgggaaccggttcattttatcacaagggaacctaatagccaattgtgcatcaatcctctgcaagtgttacacaacaggaacgatcattaatcaagaccctgacaagatcctaacatacattgctgccgatcactgcccggtggtcgaggtgaacggtgtgaccatccaagtcgggagcaggaggtatccggacgcggtgtacctgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtttacatcctgattgcagtgtgtcttggagggttgatagggatccccgctttaatatgttgctgcagggggcgctgtaacaaaaagggagaacaagttggtatgtcaagaccaggcctaaagcctgatcttacagggacatcaaaatcctatgtaaggtcgctctgatcctctacaactcttgaaacacagatttcccacaagtctcctcttcgtcatcaagcaaccaccgcatccagcatcaagcccacctgaaattgtctccggcttccctctggccgaacgatatcggtagttaattaaaacttagggtgcaagatcatccacaatgtcaccacaacgagaccgaataaatgccttctacaaagacaacccacatcctaagggaagtaggatagttattaacagagaacatcttatgattgatagaccttatgttttgctggctgttctattcgtcatgtttctgagcttgatcgggttgctagccattgcaggcattagactccatcgtgcagccatctacaccgcagagatccataagagcctcagcaccaatctagatgtaactaactcgatcgagcatcaggtcaaggacgtgctgacaccactcttcaagatcattggtgatgaagtgggcctgaggacacctcagagattcactgacctagtgaaattcatctctgacaaaattaaattccttaatccggatagggagtacgacttcagagatctcacttggtgtatcaacccgccagagagaatcaaattggattatgatcaatactgtgcagatgtggctgctgaagaactcatgaatgcattggtgaactcaactctactggaggccagggcaaccaatcagttcctagctgtctcaaagggaaactgctcagggcccactacaatcagaggtcaattctcaaacatgtcgctgtccctgttggacttgtatttaagtcgaggttacaatgtgtcatctatagtcactatgacatcccagggaatgtacgggggaacttacctagtgggaaagcctaatctgagcagtaaagggtcagagttgtcacaactgagcatgcaccgagtgtttgaagtaggggttatcagaaatccgggtttgggggctccggtgttccatatgacaaactattttgagcaaccagtcagtaatgatttcagcaactgcatggtggctttgggggagcttaaattcgcagccctctgtcacagggaagattctatcacaattccctatcaggggtcagggaaaggtgtcagcttccagctcgtcaagctaggtgtctggaaatccccaaccgacatgcgatcctgggtccccctatcaacggatgatccagtgatagataggctttatctctcatctcacagaggtgttatcgctgacaatcaagcaaaatgggctgtcccgacaacacggacagatgacaagttgcgaatggagacatgcttccagcaggcgtgtaagggtaaaaaccaagcactctgcgagaatcccgagtgggcaccattgaaggataacaggattccttcatacggggtcttgtctgttaatctgagtctgacagttgagcttaaaatcaaaattgcttcaggattcgggccattgatcacacacggttcagggatggacctatacaaaaccaaccacaacaatgtgtattggctgactatcccgccaatgaagaacctagccttaggtgtaatcaacacattggagtggataccgagattcaaggttagtcccaacctcttcactgttccaatcaaggaagcaggcgaggactgccatgccccaacatacctacctgcggaggtggatggtgatgtcaaactcagttccaatctggtaattctacctggtcaggatctccaatatgttttggcaacctacgatacttccagggttgaacatgctgtggtttattatgtttacagcccaagccgctcattttcttacttttatccttttaggttgcctataaagggggtcccaatcgaattacaagtggaatgcttcacatgggacaaaaaactctggtgccgtcacttctgtgtgcttgcggactcagaatctggtggacatatcactcactctgggatggtgggcatgggagtcagctgcacagtcactcgggaagatggaaccaatcgcagatagggctgccagtgaaccgatcacatgatgtcacccagacatcaggcatacccactagtgtgaaatagacatcagaattaagaaaaacgtagggtccaagtggtttcccgttatggactcgctatctgtcaaccagatcttataccctgaagttcacctagatagcccgatagttaccaataagatagtagctatcctggagtatgctcgagtccctcacgcttacagcctggaggaccctacactgtgtcagaacatcaagcaccgcctaaaaaacggattctccaaccaaatgattataaacaatgtggaagttgggaatgtcatcaagtccaagcttaggagttatccggcccactctcatattccatatccaaattgtaatcaggatttatttaacatagaagacaaagagtcaacaaggaagatccgtgagctcctaaaaaagggaaattcgctgtactccaaagtcagtgataaggttttccaatgcctgagggacactaactcacggcttggcctaggctccgaattgagggaggacatcaaggagaaaattattaacttgggagtttacatgcacagctcccaatggtttgagccctttctgttttggtttacagtcaagactgagatgaggtcagtgattaaatcacaaacccatacttgccataggaggagacacacacctgtattcttcactggtagttcagttgagctgttaatctctcgtgaccttgttgctataatcagtaaggaatctcaacatgtatattacctgacgtttgaactggttttgatgtattgtgatgtcatagaggggaggttaatgacagagaccgctatgaccattgatgctaggtatgcagaacttctaggaagagtcagatacatgtggaaactgatagatggtttcttccctgcactcgggaatccaacttatcaaattgtagccatgctggagccactttcacttgcttacctgcaactgagggatataacagtagaactcagaggtgctttccttaaccactgctttactgaaatacatgatgttcttgaccaaaacgggttttctgatgaaggtacttatcatgagttaattgaagccctagattacattttcataactgatgacatacatctgacaggggagattttctcatttttcagaagtttcggccaccccagacttgaagcagtaacggctgctgaaaatgtcaggaaatacatgaatcagcctaaagtcattgtgtatgagactctgatgaaaggtcatgccatattttgtggaatcataatcaacggctatcgtgacaggcacggaggcagttggccacccctgaccctccccctgcatgctgcagacacaatccggaatgctcaagcttcaggtgaagggttaacacatgagcagtgcgttgataactggaaatcatttgctggagtgagatttggctgttttatgcctcttagcctggacagtgatctgacaatgtacctaaaggacaaggcacttgctgctctccaaagggaatgggattcagtttacccgaaagagttcctgcgttacgatcctcccaagggaaccgggtcacggaggcttgtagatgttttccttaatgattcgagctttgacccatatgatatgataatgtatgtcgtaagtggagcctacctccatgaccctgagttcaacctgtcttacagcctgaaagaaaaggagatcaaggaaacaggtagacttttcgctaaaatgacttacaaaatgagggcatgccaagtgatcgctgaaaatctaatctcaaacgggattggcaagtattttaaggacaatgggatggccaaggatgagcacgatttgactaaggcactccacactctggctgtctcaggagtccccaaagatctcaaagaaagtcacaggggggggccagtcttaaaaacctactcccgaagcccagtccacacaagtaccaggaacgttaaagcagaaaaagggtttgtaggattccctcatgtaattcggcagaatcaagacactgatcatccggagaatatagaaacctacgagacagtcagcgcatttatcacgactgatctcaagaagtactgccttaattggagatatgagaccatcagcttatttgcacagaggctaaatgagatttacggattaccctcattttttcagtggctgcataagaggcttgaaacctctgtcctctatgtaagtgaccctcattgcccccccgaccttgacgcccatgtcccgttatgcaaagtccccaatgaccaaatcttcatcaagtaccctatgggaggtatagaagggtattgtcagaagctgtggaccatcagcaccattccctacttatacctggctgcttatgagagcggggtaaggattgcttcgttagtgcaaggggacaatcagaccatagccgtaacaaaaagggtacccagcacatggccttacaaccttaagaaacgggaagctgctagagtaactagagattactttgtaattcttaggcaaaggctacatgacattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcggcatgcagtaatattgctacaacaatggccaaaagcattgagagaggttatgaccgttatcttgcatattccctgaacgtcctaaaagtgatacagcaaattttgatctcccttggcttcacaatcaattcaaccatgacccgggatgtagtcatacccctcctcacaaacaacgatctcttaataaggatggcactgttgcccgctcctattgggggtatgaattatctgaatatgagcaggctgtttgtcagaaacatcggtgatccagtaacatcatcaattgctgatctcaagagaatgattctcgcatcactaatgcctgaagagaccctccatcaagtaatgacacaacaaccgggggactcttcattcctagactgggctagcgacccttactcagcaaatcttgtatgcgtccagagcatcactagactcctcaagaacataactgcaaggtttgtcctgatccacagtccaaacccaatgttaaaagggttattccatgatgacagcaaagaagaggacgagagactggcggcattcctcatggacaggcatattatagtacctagggcagctcatgaaatcctggatcatagtgtcacaggggcaagagagtctattgcaggcatgctagataccacaaaaggcctgattcgagccagcatgaggaagggggggttaacctctcgagtgataaccagattgtccaattatgactatgaacaatttagagcagggatggtgctattgacaggaagaaagagaaatgtcctcattgacaaagagtcatgttcagtgcagctggctagagccctaagaagccatatgtgggcaagactagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagctcgccttcgtaagagccccaagtagatccttgcgatctgccgttagaatagcaacagtgtactcatgggcttacggtgatgatgatagctcttggaacgaagcctggttgttggcaaggcaaagggccaatgtgagcctggaggagctaagggtgatcactcccatctcgacttcgactaatttagcgcataggttgagggatcgtagcactcaagtgaaatactcaggtacatcccttgtccgagtggcaaggtataccacaatctccaacgacaatctctcatttgtcatatcagataagaaggttgatactaactttatataccaacaaggaatgcttctagggttgggtgttttagaaacattgtttcgactcgagaaagatactggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattctagctaagtccacagcactatctatgattgacctggtaacaaaatttgagaaggaccatatgaatgaaatttcagctctcataggggatgacgatatcaatagtttcataactgagtttctgcttatagagccaagattattcaccatctacttgggccagtgtgcagccatcaattgggcatttgatgtacattatcatagaccatcagggaaatatcagatgggtgagctgttgtcttcgttcctttctagaatgagcaaaggagtgtttaaggtgcttgtcaatgctctaagccacccaaagatctacaagaaattctggcattgtggtattatagagcctatccatggtccttcacttgatgctcaaaacttgcacacaactgtgtgcaacatggtttacacatgctatatgacctacctcgacctgttgttgaatgaagagttagaagagttcacatttcttttgtgtgaaagcgatgaggatgtagtaccggacagattcgacaacatccaggcaaaacacttgtgtgttctggcagatttgtactgtcaaccagggacctgcccaccgattcgaggtctaaggccggtagagaaatgtgcagttctaaccgatcatatcaaggcagaggctaggttatctccagcaggatcttcgtggaacataaatccaattattgtagaccattactcatgctctctgacttatctccgtcgaggatctatcaaacagataagattgagagttgatccaggattcatttttgacgccctcgctgaggtaaatgtcagtcagccaaaggtcggcagcgacgtcagccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaataagacgtcatctcaaatatgagcatcaaggatttcagacctccacacgatgatgttgcaaaattgctcaaagatatcaacacaagcaagcacaatcttcccatttcagggggtagtctcgccaattatgaaatccatgctttccgcagaatcgggttaaactcatctgcttgctacaaagctgttgagatatcaacattaattaggagatgccttgagccaggggaagacggcttgttcttgggtgaggggtcgggttctatgttgatcacttataaggagatactaaaactaaacaagtgcttctataatagtggggtttccgccaattctagatctggtcaaagggaattagcaccctatccctccgaagttggccttgtcgaacacagaatgggagtaggtaatattgtcaaggtgctctttaacgggaggcccgaagtcacgtgggtaggcagtatagattgcttcaatttcatagtcagtaatatccctacctctagtgtggggtttatccattcagatatagagaccttacctaacaaagatactatagagaagctagaggaattggcagccatcttatcgatggctctactccttggcaaaataggatcaatactggtgattaagcttatgcctttcagcggggattttgttcagggatttataagctatgtagggtctcattatagagaagtgaaccttgtctaccctaggtacagcaacttcatatctactgaatcttatttagttatgacagatctcaaagctaaccggctaatgaatcctgaaaagatcaagcagcagataattgaatcatctgtacggacttcacctggacttataggtcacatcctatccattaagcaactaagctgcatacaagcaattgtgggaggcgcggttagtagaggtgatatcaaccctattctgaaaaaacttacacctatagagcaggtgctgatcagttgcgggttggcaattaacggacctaaactgtgcaaagaattaatccaccatgatgttgcctcagggcaagatggattgcttaactctatactcatcctctacagggagttggcaagattcaaagacaaccaaagaagtcaacaagggatgttccacgcttaccccgtattggtaagtagtaggcaacgagaacttgtatctaggatcactcgcaaattttgggggcatattcttctttactccgggaacagaaagttgataaatcggtttatccagaatctcaagtccggttatctagtactagacttacaccagaatatcttcgttaagaatctatccaagtcagagaaacagattattatgacggggggtttaaaacgtgagtgggtttttaaggtaacagtcaaggagaccaaagaatggtacaagttagtcggatacagcgctctgattaaggattaattggttgaactccggaaccctaatcctgccctaggtagttaggcattatttgcaatatattaaagaaaactttgaaaatacgaagtttctattcccagctttgtctggt

SEQ ID NO: 75 - DNA, 12114 bp, Artificial Sequence
  nmaghigh Lc plasmid
accaaacaaagttgggtaaggatagatcaatcaatgatcatattctagtacacttaggattcaagatcctattatcagggacaagagcaggattagggatatccgagggcgcgccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaagacgtcgagaggccgaggaccagaacaacatccgcctaccctccatcattgttataaaaaacttaggaaccaggtccacacagccgccagccaaccaaccatccactcccacgactggagttcgaacgagatggccacacttttgaggagcttagcattgttcaaaagaaacaaggacaaaccacccattacatcaggatccggtggagccatcagaggaatcaaacacattattatagtaccaattcctggagattcctcaattaccactcgatccagactactggaccggttggtcaggttaattggaaacccggatgtgagcgggcccaaactaacaggggcactaataggtatattatccttatttgtggagtctccaggtcaattgattcagaggatcaccgatgaccctgacgttagcatcaggctgttagaggttgttcagagtgaccagtcacaatctggccttaccttcgcatcaagaggtaccaacatggaggatgaggcggaccaatacttttcacatgatgatccaagcagtagtgatcaatccaggtccggatggttcgagaacaaggaaatctcagatattgaagtgcaagaccctgagggattcaacatgattctgggtaccattctagcccagatctgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctctttacgccgattcatggtggctctaatcctggatatcaagaggacacccgggaacaaacctaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaatctttaccagcaaatgggagaaactgcaccctacatggtaatcctagagaactcaattcagaacaagttcagtgcaggatcataccctctgctctggagctatgccatgggagtaggagtggaacttgaaaactccatgggaggtttgaactttggtcgatcttactttgatccagcatattttagattagggcaagagatggtgaggaggtcagctggaaaggtcagttccacattggcatccgaactcggtatcactgccgaggatgcaaggcttgtttcagagattgcaatgcatactactgaggacaggatcagtagagcggtcggacccagacaagcccaagtgtcatttctacacggtgatcaaagtgagaatgagctaccaggattggggggcaaggaagataggagggtcaaacagggtcggggagaagccagggagagctacagagaaaccgggtccagcagagcaagtgatgcgagagctgcccatcctccaaccagcatgcccctagacattgacactgcatcggagtcaggccaagatccgcaggacagtcgaaggtcagctgacgccctgctcaggctgcaagccatggcaggaatcttggaagaacaaggctcagacacggacacccctagggtatacaatgacagagatcttctagactaggtgcgagaggccgaggaccagaacaacatccgcctaccctccatcattgttataaaaaacttaggaaccaggtccacacagccgccagccaaccaaccatccactcccacgactggagccgatggcagaagagcaggcacgccatgtcaaaaacggactggaatgcatccgggctctcaaggccgagcccatcggctcactggccgtcgaggaagccatggcagcatggtcagaaatatcagacaacccaggacaggaccgagccacctgcaaggaagaggaggcaggcagttcgggtctcagcaaaccatgcctctcagcaattggatcaactgaaggcggtgcacctcgcatccgcggtcagggatctggagaaagcgatgacgacgctgaaactttgggaatcccctcaagaaatctccaggcatcaagcactgggttacagtgttatcatgtttatgatcacagcggtgaagcggttaagggaatccaagatgctgactctatcatggttcaatcaggccttgatggtgatagcaccctctcaggaggagacgatgaatctgaaaacagcgatgtggatattggcgaacctgataccgagggatatgctatcactgaccggggatctgctcccatctctatggggttcagggcttctgatgttgaaactgcagaaggaggggagatccacgagctcctgaaactccaatccagaggcaacaactttccgaagcttgggaaaactctcaatgttcctccgcccccgaaccccagtagggccagcacttccgagacacccattaaaaagggcacagacgcgagattggcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctccgatgtccaagacatcaaaacagccttggccaaaatacacgaggataatcagaagataatctccaagctagaatcattgctgttattgaagggagaagttgagtcaattaagaagcagatcaacaggcaaaatatcagcatatccaccctggaaggacacctctcaagcatcatgattgccattcctggacttgggaaggatcccaacgaccccactgcagatgtcgaactcaatcccgacctgaaacccatcataggcagagattcaggccgagcactggccgaagttctcaagaagcccgttgccagccgacaactccagggaatgactaatggacggaccagttccagaggacagctgctgaaggaatttcaactaaagccgatcgggaaaaaggtgagctcagccgtcgggtttgttcctgacaccggccctgcatcacgcagtgtaatccgctccattataaaatccagccggctagaggaggatcggaagcgttacctgatgactctccttgatgatatcaaaggagccaacgatcttgccaagttccaccagatgctgatgaagataataatgaagtagctacagctcaacttacctgccaaccccatgccagtcgacctaattagtacaacctaaatccattataaaaaacttaggagcaaagtgattgcctcctaagttccacaatgacagagatctacgatttcgacaagtcggcatgggacatcaaagggtcgatcgctccgatacaacctaccacctacagtgatggcaggctggtgccccaggtcagagtcatagatcctggtctaggtgataggaaggatgaatgctttatgtacatgtttctgctgggggttgttgaggacagcgatcccctagggcctccaatcgggcgagcattcgggtccctgcccttaggtgttggtagatccacagcaaaacccgaggaactcctcaaagaggccactgagcttgacatagttgttagacgtacagcagggctcaatgaaaaactggtgttctacaacaacaccccactaaccctcctcacaccttggagaaaggtcctaacaacagggagtgtcttcaatgcaaaccaagtgtgcaatgcggttaatctaataccgctggacaccccgcagaggttccgtgttgtttatatgagcatcacccgtctttcggataacgggtattacaccgttcccagaagaatgctggaattcagatcggtcaatgcagtggccttcaacctgctagtgacccttaggattgacaaggcgattggccctgggaagatcatcgacaatgcagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccactgatggatatcaatgaagaccttaatcggttactctggaggagcagatgcaagatagtaagaatccaggcagttttgcagccatcagttcctcaagaattccgcatttacgacgacgtgatcataaatgatgaccaaggactattcaaagttctgtagaccgcagtgcccagcaatacccgaaaacgacccccctcataatgacagccagaaggcccggacaaaaaagccccctccagaagactccacggaccaagcgagaggccagccagcagccgacagcaagtgtggacaccaggcggcccaagcacagaacagccccgacacaaggccaccaccagccatcccaatctgcgtcctcctcgtgggacccccgaggaccaaccccgaaggtcgctccgaacacagaccaccaaccgcatccccacagctcccgggaaaggaacccccagcaactggaaggcccctccccccctcccccaacgcaagaaccccacaaccgaaccgcacaagcgaccgaggtgacccaaccgcaggcatccgactccttagacagatcctctccccccggcatactaaacaaaacttagggccaaggaacacacacactcgacagaacccagaccccggcccgcggcaccgcgcccccaccccccgaaaaccagagggagcccccaaccaaacccgccggcccccccggtgcccacaggtaggcacaccaacccccgaccagacccagcacccagccaccgacaatccaagacggggggccccccccaaaaaaaggcccccaggggccgacagccagcatcgcgaggaagcacacccaccccacacacgaccacggcaaccgaaccagagtccagaccaccctgggccaccagctcccagactcggccatcaccccgcaaaaaggaaaggccacaacccgcgcaccccagccccgatccggcgggcagccactcaacccgaaccagcacccaagagcgatccctgggggacccccaaaccgcaaaagacatcagtatcccacagcctctccaagtcccccggtctcctcctcttctcgaagggaccaaaagatcaatccaccacatccgacgacactcaattccccacccccaaaggagacaccgggaatcccagaatcaagactcatccagtgtccatcatgggtctcaaggtgaacgtctctgccatattcatggcagtactgttaactctccaaacacccaccggtcaaatccattggggcaatctctctaagataggggtggtagggataggaagtgcaagctacaaagttatgactcgttccagccatcaatcattggtcataaaattaatgcccaatataactctcctcaataactgcacgagggtagagatcgcagaatacaggagactactgagaacagttttggaaccaattagagatgcacttaatgcaatgacccagaatataagaccggttcagagtgtagcttcaagtaggagacacaagagatttgcgggagttgtcctggcaggtgcggccctaggcgttgccacagctgctcagataacagccggcattgcacttcaccagtccatgctgaactctcaagccatcgacaatctgagagcaagcctggaaactactaatcaggcaattgaggcaatcagacaagcagggcaggagatgatattggctgttcagggtgtccaagactacatcaataatgagctgataccgtctatgaaccaactatcttgtgatttaatcggccagaagctagggctcaaattgctcagatactatacagaaatcctgtcattatttggccccagcttacgggaccccatatctgcggagatatccatccaggctttgagctatgcgcttggaggagatatcaataaggtattagaaaagctcggatacagtggaggtgatttactgggcatcttagagagcagaggaataaaggcccggataactcacgtcgacacagagtcctacttcattgtactcagtatagcctatccgacgctgtccgagattaagggggtgattgtccaccggctagagggggtctcgtacaatataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtccaccaagtcctgtgctcgtacactcgtatccgggtcttttgggaaccggttcattttatcacaagggaacctaatagccaattgtgcatcaatcctctgcaagtgttacacaacaggaacgatcattaatcaagaccctgacaagatcctaacatacattgctgccgatcactgcccggtggtcgaggtgaacggtgtgaccatccaagtcgggagcaggaggtatccggacgcggtgtacctgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtttacatcctgattgcagtgtgtcttggagggttgatagggatccccgctttaatatgttgctgcagggggcgctgtaacaaaaagggagaacaagttggtatgtcaagaccaggcctaaagcctgatcttacagggacatcaaaatcctatgtaaggtcgctctgatcctctacaactcttgaaacacagatttcccacaagtctcctcttcgtcatcaagcaaccaccgcatccagcatcaagcccacctgaaattgtctccggcttccctctggccgaacgatatcggtagttaattaaaacttagggtgcaagatcatccacaatgtcaccacaacgagaccgaataaatgccttctacaaagacaacccacatcctaagggaagtaggatagttattaacagagaacatcttatgattgatagaccttatgttttgctggctgttctattcgtcatgtttctgagcttgatcgggttgctagccattgcaggcattagactccatcgtgcagccatctacaccgcagagatccataagagcctcagcaccaatctagatgtaactaactcgatcgagcatcaggtcaaggacgtgctgacaccactcttcaagatcattggtgatgaagtgggcctgaggacacctcagagattcactgacctagtgaaattcatctctgacaaaattaaattccttaatccggatagggagtacgacttcagagatctcacttggtgtatcaacccgccagagagaatcaaattggattatgatcaatactgtgcagatgtggctgctgaagaactcatgaatgcattggtgaactcaactctactggaggccagggcaaccaatcagttcctagctgtctcaaagggaaactgctcagggcccactacaatcagaggtcaattctcaaacatgtcgctgtccctgttggacttgtatttaagtcgaggttacaatgtgtcatctatagtcactatgacatcccagggaatgtacgggggaacttacctagtgggaaagcctaatctgagcagtaaagggtcagagttgtcacaactgagcatgcaccgagtgtttgaagtaggggttatcagaaatccgggtttgggggctccggtgttccatatgacaaactattttgagcaaccagtcagtaatgatttcagcaactgcatggtggctttgggggagcttaaattcgcagccctctgtcacagggaagattctatcacaattccctatcaggggtcagggaaaggtgtcagcttccagctcgtcaagctaggtgtctggaaatccccaaccgacatgcgatcctgggtccccctatcaacggatgatccagtgatagataggctttatctctcatctcacagaggtgttatcgctgacaatcaagcaaaatgggctgtcccgacaacacggacagatgacaagttgcgaatggagacatgcttccagcaggcgtgtaagggtaaaaaccaagcactctgcgagaatcccgagtgggcaccattgaaggataacaggattccttcatacggggtcttgtctgttaatctgagtctgacagttgagcttaaaatcaaaattgcttcaggattcgggccattgatcacacacggttcagggatggacctatacaaaaccaaccacaacaatgtgtattggctgactatcccgccaatgaagaacctagccttaggtgtaatcaacacattggagtggataccgagattcaaggttagtcccaacctcttcactgttccaatcaaggaagcaggcgaggactgccatgccccaacatacctacctgcggaggtggatggtgatgtcaaactcagttccaatctggtaattctacctggtcaggatctccaatatgttttggcaacctacgatacttccagggttgaacatgctgtggtttattatgtttacagcccaagccgctcattttcttacttttatccttttaggttgcctataaagggggtcccaatcgaattacaagtggaatgcttcacatgggacaaaaaactctggtgccgtcacttctgtgtgcttgcggactcagaatctggtggacatatcactcactctgggatggtgggcatgggagtcagctgcacagtcactcgggaagatggaaccaatcgcagatagggctgccagtgaaccgatcacatgatgtcacccagacatcaggcatacccactagtgtgaaatagacatcagaattaagaaaaacgtagggtccaagtggtttcccgttgacgtcatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatccgcaaggcaatcgacaggaatgccgaggtgcaggttgaagtagtcaattttaaaaagaatggacagcgatttgttaatttcctgactatcatacctgttagggacgaaacaggcgagtatcgatactctatgggattccagtgcgaaacagaatatccgtacgacgtcccagattacgcgggcatctcaaatatgagcatcaaggatttcagacctccacacgatgatgttgcaaaattgctcaaagatatcaacacaagcaagcacaatcttcccatttcagggggtagtctcgccaattatgaaatccatgctttccgcagaatcgggttaaactcatctgcttgctacaaagctgttgagatatcaacattaattaggagatgccttgagccaggggaagacggcttgttcttgggtgaggggtcgggttctatgttgatcacttataaggagatactaaaactaaacaagtgcttctataatagtggggtttccgccaattctagatctggtcaaagggaattagcaccctatccctccgaagttggccttgtcgaacacagaatgggagtaggtaatattgtcaaggtgctctttaacgggaggcccgaagtcacgtgggtaggcagtatagattgcttcaatttcatagtcagtaatatccctacctctagtgtggggtttatccattcagatatagagaccttacctaacaaagatactatagagaagctagaggaattggcagccatcttatcgatggctctactccttggcaaaataggatcaatactggtgattaagcttatgcctttcagcggggattttgttcagggatttataagctatgtagggtctcattatagagaagtgaaccttgtctaccctaggtacagcaacttcatatctactgaatcttatttagttatgacagatctcaaagctaaccggctaatgaatcctgaaaagatcaagcagcagataattgaatcatctgtacggacttcacctggacttataggtcacatcctatccattaagcaactaagctgcatacaagcaattgtgggaggcgcggttagtagaggtgatatcaaccctattctgaaaaaacttacacctatagagcaggtgctgatcagttgcgggttggcaattaacggacctaaactgtgcaaagaattaatccaccatgatgttgcctcagggcaagatggattgcttaactctatactcatcctctacagggagttggcaagattcaaagacaaccaaagaagtcaacaagggatgttccacgcttaccccgtattggtaagtagtaggcaacgagaacttgtatctaggatcactcgcaaattttgggggcatattcttctttactccgggaacagaaagttgataaatcggtttatccagaatctcaagtccggttatctagtactagacttacaccagaatatcttcgttaagaatctatccaagtcagagaaacagattattatgacggggggtttaaaacgtgagtgggtttttaaggtaacagtcaaggagaccaaagaatggtacaagttagtcggatacagcgctctgattaaggattaattggttgaactccggaaccctaatcctgccctaggtagttaggcattatttgcaatatattaaagaaaactttgaaaatacgaagtttctattcccagctttgtctggt

SEQ ID NO: 76 - DNA, 450 bp, Artificial Sequence
  pMagFast1
catactctttatgcccccggtggatatgacattatgggatatctgaggcagatcaggaaccggccaaacccgcaggtggaactgggccccgtggatacatcctgcgccttgattctttgtgacctgaaacagaaagacaccccggtggtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaa

SEQ ID NO: 77 - DNA, 450 bp, Artificial Sequence
  pMagFast2
catactctttatgcccccggtggatatgacattatgggatatctgaggcagatcaggaaccggccaaacccgcaggtggaactgggccccgtggatacatcctgcgccttggtgctttgtgacctgaaacagaaagacaccccggtggtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaa

SEQ ID NO: 78 - DNA, 903 bp, Artificial Sequence
  pMag-direct-nMaghigh
catactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaaatgcacactctgtatgctccaggtggctatgacatcatgggctatctggatcagatagggaatcgtcctaatccccaagtggaacttggaccagtagacactagctgtgcactgattctctgtgacctcaagcagaaggacacacccatcgtgtacgcctctgaagcgtttctgtacatgacaggctacagcaatgccgaagtcttggggagaaattgccgatttctgcagagtcctgacggtatggtcaaacccaagtcaacgaggaaatacgtcgattccaacaccatcaacaccattcggaaagccatcgatcggaatgctgaggtgcaagtggaggttgtgaacttcaagaagaacggacagaggttcgtgaacttcctgaccataattccggttagagatgagacaggagagtaccgctattccatggggttccagtgcgaaacagaa

SEQ ID NO: 79 - DNA, 981 bp, Artificial Sequence
  pMag-linker-nMag
catactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaaaccggtaattccgctgacggcggcggaggatcgggtggtagtggtggttcaggaggaggatcgacccaaggaggatccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaa

SEQ ID NO: 80 - DNA, 1245 bp, Artificial Sequence
  pMag-4xlinker-nMaghigh
catactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaaggatccacggggaatagcgctgatggtggaggcggtagcggtggttctggtgggagtggcggaggatcaacacaaggccggaccggcggactgaagggctcttcaggcagcagcgagaacctctactttcagagcggctcaagcgggagttctgggagtggacggaccggcactggcaatagcgcagatggcggaggaggatctggcgggagcggagggagtggcggcgggtctacacagggaggccggccaggcctgaaaggcagctccggttcctctgagaacctgtacttccagtctggcagttctggctcctcaggaagcggacctgcaggcggatccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatccgcaaggcaatcgacaggaatgccgaggtgcaggttgaagtagtcaattttaaaaagaatggacagcgatttgttaatttcctgactatcatacctgttagggacgaaacaggcgagtatcgatactctatgggattccagtgcgaaacagaa

SEQ ID NO: 81 - DNA, 20942 bp, Artificial Sequence
  p(+)MV323-pMag-4xlinker-nMaghigh
accaaacaaagttgggtaaggatagatcaatcaatgatcatattctagtacacttaggattcaagatcctattatcagggacaagagcaggattagggatatccgagggcgcgccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaagacgtcgagaggccgaggaccagaacaacatccgcctaccctccatcattgttataaaaaacttaggaaccaggtccacacagccgccagccaaccaaccatccactcccacgactggagttcgaacgagatggccacacttttgaggagcttagcattgttcaaaagaaacaaggacaaaccacccattacatcaggatccggtggagccatcagaggaatcaaacacattattatagtaccaattcctggagattcctcaattaccactcgatccagactactggaccggttggtcaggttaattggaaacccggatgtgagcgggcccaaactaacaggggcactaataggtatattatccttatttgtggagtctccaggtcaattgattcagaggatcaccgatgaccctgacgttagcatcaggctgttagaggttgttcagagtgaccagtcacaatctggccttaccttcgcatcaagaggtaccaacatggaggatgaggcggaccaatacttttcacatgatgatccaagcagtagtgatcaatccaggtccggatggttcgagaacaaggaaatctcagatattgaagtgcaagaccctgagggattcaacatgattctgggtaccattctagcccagatctgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctctttacgccgattcatggtggctctaatcctggatatcaagaggacacccgggaacaaacctaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaatctttaccagcaaatgggagaaactgcaccctacatggtaatcctagagaactcaattcagaacaagttcagtgcaggatcataccctctgctctggagctatgccatgggagtaggagtggaacttgaaaactccatgggaggtttgaactttggtcgatcttactttgatccagcatattttagattagggcaagagatggtgaggaggtcagctggaaaggtcagttccacattggcatccgaactcggtatcactgccgaggatgcaaggcttgtttcagagattgcaatgcatactactgaggacaggatcagtagagcggtcggacccagacaagcccaagtgtcatttctacacggtgatcaaagtgagaatgagctaccaggattggggggcaaggaagataggagggtcaaacagggtcggggagaagccagggagagctacagagaaaccgggtccagcagagcaagtgatgcgagagctgcccatcctccaaccagcatgcccctagacattgacactgcatcggagtcaggccaagatccgcaggacagtcgaaggtcagctgacgccctgctcaggctgcaagccatggcaggaatcttggaagaacaaggctcagacacggacacccctagggtatacaatgacagagatcttctagactaggtgcgagaggccgaggaccagaacaacatccgcctaccctccatcattgttataaaaaacttaggaaccaggtccacacagccgccagccaaccaaccatccactcccacgactggagccgatggcagaagagcaggcacgccatgtcaaaaacggactggaatgcatccgggctctcaaggccgagcccatcggctcactggccgtcgaggaagccatggcagcatggtcagaaatatcagacaacccaggacaggaccgagccacctgcaaggaagaggaggcaggcagttcgggtctcagcaaaccatgcctctcagcaattggatcaactgaaggcggtgcacctcgcatccgcggtcagggatctggagaaagcgatgacgacgctgaaactttgggaatcccctcaagaaatctccaggcatcaagcactgggttacagtgttatcatgtttatgatcacagcggtgaagcggttaagggaatccaagatgctgactctatcatggttcaatcaggccttgatggtgatagcaccctctcaggaggagacgatgaatctgaaaacagcgatgtggatattggcgaacctgataccgagggatatgctatcactgaccggggatctgctcccatctctatggggttcagggcttctgatgttgaaactgcagaaggaggggagatccacgagctcctgaaactccaatccagaggcaacaactttccgaagcttgggaaaactctcaatgttcctccgcccccgaaccccagtagggccagcacttccgagacacccattaaaaagggcacagacgcgagattggcctcatttggaacggagatcgcgtctttattgacaggtggtgcaacccaatgtgctcgaaagtcaccctcggaaccatcagggccaggtgcacctgctgggaatgtccccgagtgtgtgagcaatgccgcactgatacaggagtggacacccgaatctggtaccacaatctccccgagatcccagaataatgaagaagggggagactattatgatgatgagctgttctccgatgtccaagacatcaaaacagccttggccaaaatacacgaggataatcagaagataatctccaagctagaatcattgctgttattgaagggagaagttgagtcaattaagaagcagatcaacaggcaaaatatcagcatatccaccctggaaggacacctctcaagcatcatgattgccattcctggacttgggaaggatcccaacgaccccactgcagatgtcgaactcaatcccgacctgaaacccatcataggcagagattcaggccgagcactggccgaagttctcaagaagcccgttgccagccgacaactccagggaatgactaatggacggaccagttccagaggacagctgctgaaggaatttcaactaaagccgatcgggaaaaaggtgagctcagccgtcgggtttgttcctgacaccggccctgcatcacgcagtgtaatccgctccattataaaatccagccggctagaggaggatcggaagcgttacctgatgactctccttgatgatatcaaaggagccaacgatcttgccaagttccaccagatgctgatgaagataataatgaagtagctacagctcaacttacctgccaaccccatgccagtcgacctaattagtacaacctaaatccattataaaaaacttaggagcaaagtgattgcctcctaagttccacaatgacagagatctacgatttcgacaagtcggcatgggacatcaaagggtcgatcgctccgatacaacctaccacctacagtgatggcaggctggtgccccaggtcagagtcatagatcctggtctaggtgataggaaggatgaatgctttatgtacatgtttctgctgggggttgttgaggacagcgattccctagggcctccaatcgggcgagcattcgggtccctgcccttaggtgttggtagatccacagcaaaacccgagaaactcctcaaagaggccactgagcttgacatagttgttagacgtacagcagggctcaatgaaaaactggtgttctacaacaacaccccactaaccctcctcacaccttggagaaaggtcctaacaacagggagtgtcttcaatgcaaaccaagtgtgcaatgcggttaatctaataccgctggacaccccgcagaggttccgtgttgtttatatgagcatcacccgtctttcggataacgggtattacaccgttcccagaagaatgctggaattcagatcggtcaatgcagtggccttcaacctgctagtgacccttaggattgacaaggcgattggccctgggaagatcatcgacaatgcagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccactgatggatatcaatgaagaccttaatcggttactctggaggagcagatgcaagatagtaagaatccaggcagttttgcagccatcagttcctcaagaattccgcatttacgacgacgtgatcataaatgatgaccaaggactattcaaagttctgtagaccgcagtgcccagcaatacccgaaaacgacccccctcataatgacagccagaaggcccggacaaaaaagccccctccagaagactccacggaccaagcgagaggccagccagcagccgacagcaagtgtggacaccaggcggcccaagcacagaacagccccgacacaaggccaccaccagccatcccaatctgcgtcctcctcgtgggacccccgaggaccaaccccgaaggtcgctccgaacacagaccaccaaccgcatccccacagctcccgggaaaggaacccccagcaactggaaggcccctccccccctcccccaacgcaagaaccccacaaccgaaccgcacaagcgaccgaggtgacccaaccgcaggcatccgactccttagacagatcctctccccccggcatactaaacaaaacttagggccaaggaacacacacactcgacagaacccagaccccggcccgcggcaccgcgcccccaccccccgaaaaccagagggagcccccaaccaaacccgccggcccccccggtgcccacaggtaggcacaccaacccccgaccagacccagcacccagccaccgacaatccaagacggggggccccccccaaaaaaaggcccccaggggccgacagccagcatcgcgaggaagcacacccaccccacacacgaccacggcaaccgaaccagagtccagaccaccctgggccaccagctcccagactcggccatcaccccgcaaaaaggaaaggccacaacccgcgcaccccagccccgatccggcgggcagccactcaacccgaaccagcacccaagagcgatccctgggggacccccaaaccgcaaaagacatcagtatcccacagcctctccaagtcccccggtctcctcctcttctcgaagggaccaaaagatcaatccaccacatccgacgacactcaattccccacccccaaaggagacaccgggaatcccagaatcaagactcatccagtgtccatcatgggtctcaaggtgaacgtctctgccatattcatggcagtactgttaactctccaaacacccaccggtcaaatccattggggcaatctctctaagataggggtggtagggataggaagtgcaagctacaaagttatgactcgttccagccatcaatcattggtcataaaattaatgcccaatataactctcctcaataactgcacgagggtagagatcgcagaatacaggagactactgagaacagttttggaaccaattagagatgcacttaatgcaatgacccagaatataagaccggttcagagtgtagcttcaagtaggagacacaagagatttgcgggagttgtcctggcaggtgcggccctaggcgttgccacagctgctcagataacagccggcattgcacttcaccagtccatgctgaactctcaagccatcgacaatctgagagcaagcctggaaactactaatcaggcaattgaggcaatcagacaagcagggcaggagatgatattggctgttcagggtgtccaagactacatcaataatgagctgataccgtctatgaaccaactatcttgtgatttaatcggccagaagctagggctcaaattgctcagatactatacagaaatcctgtcattatttggccccagcttacgggaccccatatctgcggagatatccatccaggctttgagctatgcgcttggaggagatatcaataaggtattagaaaagctcggatacagtggaggtgatttactgggcatcttagagagcagaggaataaaggcccggataactcacgtcgacacagagtcctacttcattgtactcagtatagcctatccgacgctgtccgagattaagggggtgattgtccaccggctagagggggtctcgtacaatataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtccaccaagtcctgtgctcgtacactcgtatccgggtcttttgggaaccggttcattttatcacaagggaacctaatagccaattgtgcatcaatcctctgcaagtgttacacaacaggaacgatcattaatcaagaccctgacaagatcctaacatacattgctgccgatcactgcccggtggtcgaggtgaacggtgtgaccatccaagtcgggagcaggaggtatccggacgcggtgtacctgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtttacatcctgattgcagtgtgtcttggagggttgatagggatccccgctttaatatgttgctgcagggggcgctgtaacaaaaagggagaacaagttggtatgtcaagaccaggcctaaagcctgatcttacagggacatcaaaatcctatgtaaggtcgctctgatcctctacaactcttgaaacacagatttcccacaagtctcctcttcgtcatcaagcaaccaccgcatccagcatcaagcccacctgaaattgtctccggcttccctctggccgaacgatatcggtagttaattaaaacttagggtgcaagatcatccacaatgtcaccacaacgagaccgaataaatgccttctacaaagacaacccacatcctaagggaagtaggatagttattaacagagaacatcttatgattgatagaccttatgttttgctggctgttctattcgtcatgtttctgagcttgatcgggttgctagccattgcaggcattagactccatcgtgcagccatctacaccgcagagatccataagagcctcagcaccaatctagatgtaactaactcgatcgagcatcaggtcaaggacgtgctgacaccactcttcaagatcattggtgatgaagtgggcctgaggacacctcagagattcactgacctagtgaaattcatctctgacaaaattaaattccttaatccggatagggagtacgacttcagagatctcacttggtgtatcaacccgccagagagaatcaaattggattatgatcaatactgtgcagatgtggctgctgaagaactcatgaatgcattggtgaactcaactctactggaggccagggcaaccaatcagttcctagctgtctcaaagggaaactgctcagggcccactacaatcagaggtcaattctcaaacatgtcgctgtccctgttggacttgtatttaagtcgaggttacaatgtgtcatctatagtcactatgacatcccagggaatgtacgggggaacttacctagtgggaaagcctaatctgagcagtaaagggtcagagttgtcacaactgagcatgcaccgagtgtttgaagtaggggttatcagaaatccgggtttgggggctccggtgttccatatgacaaactattttgagcaaccagtcagtaatgatttcagcaactgcatggtggctttgggggagcttaaattcgcagccctctgtcacagggaagattctatcacaattccctatcaggggtcagggaaaggtgtcagcttccagctcgtcaagctaggtgtctggaaatccccaaccgacatgcgatcctgggtccccctatcaacggatgatccagtgatagataggctttatctctcatctcacagaggtgttatcgctgacaatcaagcaaaatgggctgtcccgacaacacggacagatgacaagttgcgaatggagacatgcttccagcaggcgtgtaagggtaaaaaccaagcactctgcgagaatcccgagtgggcaccattgaaggataacaggattccttcatacggggtcttgtctgttaatctgagtctgacagttgagcttaaaatcaaaattgcttcaggattcgggccattgatcacacacggttcagggatggacctatacaaaaccaaccacaacaatgtgtattggctgactatcccgccaatgaagaacctagccttaggtgtaatcaacacattggagtggataccgagattcaaggttagtcccaacctcttcactgttccaatcaaggaagcaggcgaggactgccatgccccaacatacctacctgcggaggtggatggtgatgtcaaactcagttccaatctggtaattctacctggtcaggatctccaatatgttttggcaacctacgatacttccagggttgaacatgctgtggtttattatgtttacagcccaagccgctcattttcttacttttatccttttaggttgcctataaagggggtcccaatcgaattacaagtggaatgcttcacatgggacaaaaaactctggtgccgtcacttctgtgtgcttgcggactcagaatctggtggacatatcactcactctgggatggtgggcatgggagtcagctgcacagtcactcgggaagatggaaccaatcgcagatagggctgccagtgaaccgatcacatgatgtcacccagacatcaggcatacccactagtgtgaaatagacatcagaattaagaaaaacgtagggtccaagtggtttcccgttatggactcgctatctgtcaaccagatcttataccctgaagttcacctagatagcccgatagttaccaataagatagtagctatcctggagtatgctcgagtccctcacgcttacagcctggaggaccctacactgtgtcagaacatcaagcaccgcctaaaaaacggattctccaaccaaatgattataaacaatgtggaagttgggaatgtcatcaagtccaagcttaggagttatccggcccactctcatattccatatccaaattgtaatcaggatttatttaacatagaagacaaagagtcaacaaggaagatccgtgagctcctaaaaaagggaaattcgctgtactccaaagtcagtgataaggttttccaatgcctgagggacactaactcacggcttggcctaggctccgaattgagggaggacatcaaggagaaaattattaacttgggagtttacatgcacagctcccaatggtttgagccctttctgttttggtttacagtcaagactgagatgaggtcagtgattaaatcacaaacccatacttgccataggaggagacacacacctgtattcttcactggtagttcagttgagctgttaatctctcgtgaccttgttgctataatcagtaaggaatctcaacatgtatattacctgacgtttgaactggttttgatgtattgtgatgtcatagaggggaggttaatgacagagaccgctatgaccattgatgctaggtatgcagaacttctaggaagagtcagatacatgtggaaactgatagatggtttcttccctgcactcgggaatccaacttatcaaattgtagccatgctggagccactttcacttgcttacctgcaactgagggatataacagtagaactcagaggtgctttccttaaccactgctttactgaaatacatgatgttcttgaccaaaacgggttttctgatgaaggtacttatcatgagttaattgaagccctagattacattttcataactgatgacatacatctgacaggggagattttctcatttttcagaagtttcggccaccccagacttgaagcagtaacggctgctgaaaatgtcaggaaatacatgaatcagcctaaagtcattgtgtatgagactctgatgaaaggtcatgccatattttgtggaatcataatcaacggctatcgtgacaggcacggaggcagttggccacccctgaccctccccctgcatgctgcagacacaatccggaatgctcaagcttcaggtgaagggttaacacatgagcagtgcgttgataactggaaatcatttgctggagtgagatttggctgttttatgcctcttagcctggacagtgatctgacaatgtacctaaaggacaaggcacttgctgctctccaaagggaatgggattcagtttacccgaaagagttcctgcgttacgatcctcccaagggaaccgggtcacggaggcttgtagatgttttccttaatgattcgagctttgacccatatgatatgataatgtatgtcgtaagtggagcctacctccatgaccctgagttcaacctgtcttacagcctgaaagaaaaggagatcaaggaaacaggtagacttttcgctaaaatgacttacaaaatgagggcatgccaagtgatcgctgaaaatctaatctcaaacgggattggcaagtattttaaggacaatgggatggccaaggatgagcacgatttgactaaggcactccacactctggctgtctcaggagtccccaaagatctcaaagaaagtcacaggggggggccagtcttaaaaacctactcccgaagcccagtccacacaagtaccaggaacgttaaagcagaaaaagggtttgtaggattccctcatgtaattcggcagaatcaagacactgatcatccggagaatatagaaacctacgagacagtcagcgcatttatcacgactgatctcaagaagtactgccttaattggagatatgagaccatcagcttatttgcacagaggctaaatgagatttacggattaccctcattttttcagtggctgcataagaggcttgaaacctctgtcctctatgtaagtgaccctcattgcccccccgaccttgacgcccatgtcccgttatgcaaagtccccaatgaccaaatcttcatcaagtaccctatgggaggtatagaagggtattgtcagaagctgtggaccatcagcaccattccctacttatacctggctgcttatgagagcggggtaaggattgcttcgttagtgcaaggggacaatcagaccatagccgtaacaaaaagggtacccagcacatggccttacaaccttaagaaacgggaagctgctagagtaactagagattactttgtaattcttaggcaaaggctacatgacattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcggcatgcagtaatattgctacaacaatggccaaaagcattgagagaggttatgaccgttatcttgcatattccctgaacgtcctaaaagtgatacagcaaattttgatctcccttggcttcacaatcaattcaaccatgacccgggatgtagtcatacccctcctcacaaacaacgatctcttaataaggatggcactgttgcccgctcctattgggggtatgaattatctgaatatgagcaggctgtttgtcagaaacatcggtgatccagtaacatcatcaattgctgatctcaagagaatgattctcgcatcactaatgcctgaagagaccctccatcaagtaatgacacaacaaccgggggactcttcattcctagactgggctagcgacccttactcagcaaatcttgtatgcgtccagagcatcactagactcctcaagaacataactgcaaggtttgtcctgatccacagtccaaacccaatgttaaaagggttattccatgatgacagcaaagaagaggacgagagactggcggcattcctcatggacaggcatattatagtacctagggcagctcatgaaatcctggatcatagtgtcacaggggcaagagagtctattgcaggcatgctagataccacaaaaggcctgattcgagccagcatgaggaagggggggttaacctctcgagtgataaccagattgtccaattatgactatgaacaatttagagcagggatggtgctattgacaggaagaaagagaaatgtcctcattgacaaagagtcatgttcagtgcagctggctagagccctaagaagccatatgtgggcaagactagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagctcgccttcgtaagagccccaagtagatccttgcgatctgccgttagaatagcaacagtgtactcatgggcttacggtgatgatgatagctcttggaacgaagcctggttgttggcaaggcaaagggccaatgtgagcctggaggagctaagggtgatcactcccatctcgacttcgactaatttagcgcataggttgagggatcgtagcactcaagtgaaatactcaggtacatcccttgtccgagtggcaaggtataccacaatctccaacgacaatctctcatttgtcatatcagataagaaggttgatactaactttatataccaacaaggaatgcttctagggttgggtgttttagaaacattgtttcgactcgagaaagatactggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattctagctaagtccacagcactatctatgattgacctggtaacaaaatttgagaaggaccatatgaatgaaatttcagctctcataggggatgacgatatcaatagtttcataactgagtttctgcttatagagccaagattattcaccatctacttgggccagtgtgcagccatcaattgggcatttgatgtacattatcatagaccatcagggaaatatcagatgggtgagctgttgtcttcgttcctttctagaatgagcaaaggagtgtttaaggtgcttgtcaatgctctaagccacccaaagatctacaagaaattctggcattgtggtattatagagcctatccatggtccttcacttgatgctcaaaacttgcacacaactgtgtgcaacatggtttacacatgctatatgacctacctcgacctgttgttgaatgaagagttagaagagttcacatttcttttgtgtgaaagcgatgaggatgtagtaccggacagattcgacaacatccaggcaaaacacttgtgtgttctggcagatttgtactgtcaaccagggacctgcccaccgattcgaggtctaaggccggtagagaaatgtgcagttctaaccgatcatatcaaggcagaggctaggttatctccagcaggatcttcgtggaacataaatccaattattgtagaccattactcatgctctctgacttatctccgtcgaggatctatcaaacagataagattgagagttgatccaggattcatttttgacgccctcgctgaggtaaatgtcagtcagccaaaggtcggcagcgacgtgagccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaaggatccacggggaatagcgctgatggtggaggcggtagcggtggttctggtgggagtggcggaggatcaacacaaggccggaccggcggactgaagggctcttcaggcagcagcgagaacctctactttcagagcggctcaagcgggagttctgggagtggacggaccggcactggcaatagcgcagatggcggaggaggatctggcgggagcggagggagtggcggcgggtctacacagggaggccggccaggcctgaaaggcagctccggttcctctgagaacctgtacttccagtctggcagttctggctcctcaggaagcggacctgcaggcggatccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatccgcaaggcaatcgacaggaatgccgaggtgcaggttgaagtagtcaattttaaaaagaatggacagcgatttgttaatttcctgactatcatacctgttagggacgaaacaggcgagtatcgatactctatgggattccagtgcgaaacagaatatccgtacgatgtcccagattacgcgggcatctcaaatatgagcatcaaggatttcagacctccacacgatgatgttgcaaaattgctcaaagatatcaacacaagcaagcacaatcttcccatttcagggggtagtctcgccaattatgaaatccatgctttccgcagaatcgggttaaactcatctgcttgctacaaagctgttgagatatcaacattaattaggagatgccttgagccaggggaagacggcttgttcttgggtgaggggtcgggttctatgttgatcacttataaggagatactaaaactaaacaagtgcttctataatagtggggtttccgccaattctagatctggtcaaagggaattagcaccctatccctccgaagttggccttgtcgaacacagaatgggagtaggtaatattgtcaaggtgctctttaacgggaggcccgaagtcacgtgggtaggcagtatagattgcttcaatttcatagtcagtaatatccctacctctagtgtggggtttatccattcagatatagagaccttacctaacaaagatactatagagaagctagaggaattggcagccatcttatcgatggctctactccttggcaaaataggatcaatactggtgattaagcttatgcctttcagcggggattttgttcagggatttataagctatgtagggtctcattatagagaagtgaaccttgtctaccctaggtacagcaacttcatatctactgaatcttatttagttatgacagatctcaaagctaaccggctaatgaatcctgaaaagatcaagcagcagataattgaatcatctgtacggacttcacctggacttataggtcacatcctatccattaagcaactaagctgcatacaagcaattgtgggaggcgcggttagtagaggtgatatcaaccctattctgaaaaaacttacacctatagagcaggtgctgatcagttgcgggttggcaattaacggacctaaactgtgcaaagaattaatccaccatgatgttgcctcagggcaagatggattgcttaactctatactcatcctctacagggagttggcaagattcaaagacaaccaaagaagtcaacaagggatgttccacgcttaccccgtattggtaagtagtaggcaacgagaacttgtatctaggatcactcgcaaattttgggggcatattcttctttactccgggaacagaaagttgataaatcggtttatccagaatctcaagtccggttatctagtactagacttacaccagaatatcttcgttaagaatctatccaagtcagagaaacagattattatgacggggggtttaaaacgtgagtgggtttttaaggtaacagtcaaggagaccaaagaatggtacaagttagtcggatacagcgctctgattaaggattaattggttgaactccggaaccctaatcctgccctaggtagttaggcattatttgcaatatattaaagaaaactttgaaaatacgaagtttctattcccagctttgtctggtggccggcatggtcccagcctcctcgctggcgccggctgggcaacattccgaggggaccgtcccctcggtaatggcgaatgggacgcggccgccgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgccagtgaattgtaatacgactcactata

SEQ ID NO: 82 - DNA, 20600 bp, Artificial Sequence
  p(+)MV323-pMag-direct-nMaghigh
accaaacaaagttgggtaaggatagatcaatcaatgatcatattctagtacacttaggattcaagatcctattatcagggacaagagcaggattagggatatccgagggcgcgccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaagacgtcgagaggccgaggaccagaacaacatccgcctaccctccatcattgttataaaaaacttaggaaccaggtccacacagccgccagccaaccaaccatccactcccacgactggagttcgaacgagatggccacacttttgaggagcttagcattgttcaaaagaaacaaggacaaaccacccattacatcaggatccggtggagccatcagaggaatcaaacacattattatagtaccaattcctggagattcctcaattaccactcgatccagactactggaccggttggtcaggttaattggaaacccggatgtgagcgggcccaaactaacaggggcactaataggtatattatccttatttgtggagtctccaggtcaattgattcagaggatcaccgatgaccctgacgttagcatcaggctgttagaggttgttcagagtgaccagtcacaatctggccttaccttcgcatcaagaggtaccaacatggaggatgaggcggaccaatacttttcacatgatgatccaagcagtagtgatcaatccaggtccggatggttcgagaacaaggaaatctcagatattgaagtgcaagaccctgagggattcaacatgattctgggtaccattctagcccagatctgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctctttacgccgattcatggtggctctaatcctggatatcaagaggacacccgggaacaaacctaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaatctttaccagcaaatgggagaaactgcaccctacatggtaatcctagagaactcaattcagaacaagttcagtgcaggatcataccctctgctctggagctatgccatgggagtaggagtggaacttgaaaactccatgggaggtttgaactttggtcgatcttactttgatccagcatattttagattagggcaagagatggtgaggaggtcagctggaaaggtcagttccacattggcatccgaactcggtatcactgccgaggatgcaaggcttgtttcagagattgcaatgcatactactgaggacaggatcagtagagcggtcggacccagacaagcccaagtgtcatttctacacggtgatcaaagtgagaatgagctaccaggattggggggcaaggaagataggagggtcaaacagggtcggggagaagccagggagagctacagagaaaccgggtccagcagagcaagtgatgcgagagctgcccatcctccaaccagcatgcccctagacattgacactgcatcggagtcaggccaagatccgcaggacagtcgaaggtcagctgacgccctgctcaggctgcaagccatggcaggaatcttggaagaacaaggctcagacacggacacccctagggtatacaatgacagagatcttctagactaggtgcgagaggccgaggaccagaacaacatccgcctaccctccatcattgttataaaaaacttaggaaccaggtccacacagccgccagccaaccaaccatccactcccacgactggagccgatggcagaagagcaggcacgccatgtcaaaaacggactggaatgcatccgggctctcaaggccgagcccatcggctcactggccgtcgaggaagccatggcagcatggtcagaaatatcagacaacccaggacaggaccgagccacctgcaaggaagaggaggcaggcagttcgggtctcagcaaaccatgcctctcagcaattggatcaactgaaggcggtgcacctcgcatccgcggtcagggatctggagaaagcgatgacgacgctgaaactttgggaatcccctcaagaaatctccaggcatcaagcactgggttacagtgttatcatgtttatgatcacagcggtgaagcggttaagggaatccaagatgctgactctatcatggttcaatcaggccttgatggtgatagcaccctctcaggaggagacgatgaatctgaaaacagcgatgtggatattggcgaacctgataccgagggatatgctatcactgaccggggatctgctcccatctctatggggttcagggcttctgatgttgaaactgcagaaggaggggagatccacgagctcctgaaactccaatccagaggcaacaactttccgaagcttgggaaaactctcaatgttcctccgcccccgaaccccagtagggccagcacttccgagacacccattaaaaagggcacagacgcgagattggcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctccgatgtccaagacatcaaaacagccttggccaaaatacacgaggataatcagaagataatctccaagctagaatcattgctgttattgaagggagaagttgagtcaattaagaagcagatcaacaggcaaaatatcagcatatccaccctggaaggacacctctcaagcatcatgattgccattcctggacttgggaaggatcccaacgaccccactgcagatgtcgaactcaatcccgacctgaaacccatcataggcagagattcaggccgagcactggccgaagttctcaagaagcccgttgccagccgacaactccagggaatgactaatggacggaccagttccagaggacagctgctgaaggaatttcaactaaagccgatcgggaaaaaggtgagctcagccgtcgggtttgttcctgacaccggccctgcatcacgcagtgtaatccgctccattataaaatccagccggctagaggaggatcggaagcgttacctgatgactctccttgatgatatcaaaggagccaacgatcttgccaagttccaccagatgctgatgaagataataatgaagtagctacagctcaacttacctgccaaccccatgccagtcgacctaattagtacaacctaaatccattataaaaaacttaggagcaaagtgattgcctcctaagttccacaatgacagagatctacgatttcgacaagtcggcatgggacatcaaagggtcgatcgctccgatacaacctaccacctacagtgatggcaggctggtgccccaggtcagagtcatagatcctggtctaggtgataggaaggatgaatgctttatgtacatgtttctgctgggggttgttgaggacagcgatcccctagggcctccaatcgggcgagcattcgggtccctgcccttaggtgttggtagatccacagcaaaacccgaggaactcctcaaagaggccactgagcttgacatagttgttagacgtacagcagggctcaatgaaaaactggtgttctacaacaacaccccactaaccctcctcacaccttggagaaaggtcctaacaacagggagtgtcttcaatgcaaaccaagtgtgcaatgcggttaatctaataccgctggacaccccgcagaggttccgtgttgtttatatgagcatcacccgtctttcggataacgggtattacaccgttcccagaagaatgctggaattcagatcggtcaatgcagtggccttcaacctgctagtgacccttaggattgacaaggcgattggccctgggaagatcatcgacaatgcagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccactgatggatatcaatgaagaccttaatcggttactctggaggagcagatgcaagatagtaagaatccaggcagttttgcagccatcagttcctcaagaattccgcatttacgacgacgtgatcataaatgatgaccaaggactattcaaagttctgtagaccgcagtgcccagcaatacccgaaaacgacccccctcataatgacagccagaaggcccggacaaaaaagccccctccagaagactccacggaccaagcgagaggccagccagcagccgacagcaagtgtggacaccaggcggcccaagcacagaacagccccgacacaaggccaccaccagccatcccaatctgcgtcctcctcgtgggacccccgaggaccaaccccgaaggtcgctccgaacacagaccaccaaccgcatccccacagctcccgggaaaggaacccccagcaactggaaggcccctccccccctcccccaacgcaagaaccccacaaccgaaccgcacaagcgaccgaggtgacccaaccgcaggcatccgactccttagacagatcctctccccccggcatactaaacaaaacttagggccaaggaacacacacactcgacagaacccagaccccggcccgcggcaccgcgcccccaccccccgaaaaccagagggagcccccaaccaaacccgccggcccccccggtgcccacaggtaggcacaccaacccccgaccagacccagcacccagccaccgacaatccaagacggggggccccccccaaaaaaaggcccccaggggccgacagccagcatcgcgaggaagcacacccaccccacacacgaccacggcaaccgaaccagagtccagaccaccctgggccaccagctcccagactcggccatcaccccgcaaaaaggaaaggccacaacccgcgcaccccagccccgatccggcgggcagccactcaacccgaaccagcacccaagagcgatccctgggggacccccaaaccgcaaaagacatcagtatcccacagcctctccaagtcccccggtctcctcctcttctcgaagggaccaaaagatcaatccaccacatccgacgacactcaattccccacccccaaaggagacaccgggaatcccagaatcaagactcatccagtgtccatcatgggtctcaaggtgaacgtctctgccatattcatggcagtactgttaactctccaaacacccaccggtcaaatccattggggcaatctctctaagataggggtggtagggataggaagtgcaagctacaaagttatgactcgttccagccatcaatcattggtcataaaattaatgcccaatataactctcctcaataactgcacgagggtagagatcgcagaatacaggagactactgagaacagttttggaaccaattagagatgcacttaatgcaatgacccagaatataagaccggttcagagtgtagcttcaagtaggagacacaagagatttgcgggagttgtcctggcaggtgcggccctaggcgttgccacagctgctcagataacagccggcattgcacttcaccagtccatgctgaactctcaagccatcgacaatctgagagcaagcctggaaactactaatcaggcaattgaggcaatcagacaagcagggcaggagatgatattggctgttcagggtgtccaagactacatcaataatgagctgataccgtctatgaaccaactatcttgtgatttaatcggccagaagctagggctcaaattgctcagatactatacagaaatcctgtcattatttggccccagcttacgggaccccatatctgcggagatatccatccaggctttgagctatgcgcttggaggagatatcaataaggtattagaaaagctcggatacagtggaggtgatttactgggcatcttagagagcagaggaataaaggcccggataactcacgtcgacacagagtcctacttcattgtactcagtatagcctatccgacgctgtccgagattaagggggtgattgtccaccggctagagggggtctcgtacaatataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtccaccaagtcctgtgctcgtacactcgtatccgggtcttttgggaaccggttcattttatcacaagggaacctaatagccaattgtgcatcaatcctctgcaagtgttacacaacaggaacgatcattaatcaagaccctgacaagatcctaacatacattgctgccgatcactgcccggtggtcgaggtgaacggtgtgaccatccaagtcgggagcaggaggtatccggacgcggtgtacctgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtttacatcctgattgcagtgtgtcttggagggttgatagggatccccgctttaatatgttgctgcagggggcgctgtaacaaaaagggagaacaagttggtatgtcaagaccaggcctaaagcctgatcttacagggacatcaaaatcctatgtaaggtcgctctgatcctctacaactcttgaaacacagatttcccacaagtctcctcttcgtcatcaagcaaccaccgcatccagcatcaagcccacctgaaattgtctccggcttccctctggccgaacgatatcggtagttaattaaaacttagggtgcaagatcatccacaatgtcaccacaacgagaccgaataaatgccttctacaaagacaacccacatcctaagggaagtaggatagttattaacagagaacatcttatgattgatagaccttatgttttgctggctgttctattcgtcatgtttctgagcttgatcgggttgctagccattgcaggcattagactccatcgtgcagccatctacaccgcagagatccataagagcctcagcaccaatctagatgtaactaactcgatcgagcatcaggtcaaggacgtgctgacaccactcttcaagatcattggtgatgaagtgggcctgaggacacctcagagattcactgacctagtgaaattcatctctgacaaaattaaattccttaatccggatagggagtacgacttcagagatctcacttggtgtatcaacccgccagagagaatcaaattggattatgatcaatactgtgcagatgtggctgctgaagaactcatgaatgcattggtgaactcaactctactggaggccagggcaaccaatcagttcctagctgtctcaaagggaaactgctcagggcccactacaatcagaggtcaattctcaaacatgtcgctgtccctgttggacttgtatttaagtcgaggttacaatgtgtcatctatagtcactatgacatcccagggaatgtacgggggaacttacctagtgggaaagcctaatctgagcagtaaagggtcagagttgtcacaactgagcatgcaccgagtgtttgaagtaggggttatcagaaatccgggtttgggggctccggtgttccatatgacaaactattttgagcaaccagtcagtaatgatttcagcaactgcatggtggctttgggggagcttaaattcgcagccctctgtcacagggaagattctatcacaattccctatcaggggtcagggaaaggtgtcagcttccagctcgtcaagctaggtgtctggaaatccccaaccgacatgcgatcctgggtccccctatcaacggatgatccagtgatagataggctttatctctcatctcacagaggtgttatcgctgacaatcaagcaaaatgggctgtcccgacaacacggacagatgacaagttgcgaatggagacatgcttccagcaggcgtgtaagggtaaaaaccaagcactctgcgagaatcccgagtgggcaccattgaaggataacaggattccttcatacggggtcttgtctgttaatctgagtctgacagttgagcttaaaatcaaaattgcttcaggattcgggccattgatcacacacggttcagggatggacctatacaaaaccaaccacaacaatgtgtattggctgactatcccgccaatgaagaacctagccttaggtgtaatcaacacattggagtggataccgagattcaaggttagtcccaacctcttcactgttccaatcaaggaagcaggcgaggactgccatgccccaacatacctacctgcggaggtggatggtgatgtcaaactcagttccaatctggtaattctacctggtcaggatctccaatatgttttggcaacctacgatacttccagggttgaacatgctgtggtttattatgtttacagcccaagccgctcattttcttacttttatccttttaggttgcctataaagggggtcccaatcgaattacaagtggaatgcttcacatgggacaaaaaactctggtgccgtcacttctgtgtgcttgcggactcagaatctggtggacatatcactcactctgggatggtgggcatgggagtcagctgcacagtcactcgggaagatggaaccaatcgcagatagggctgccagtgaaccgatcacatgatgtcacccagacatcaggcatacccactagtgtgaaatagacatcagaattaagaaaaacgtagggtccaagtggtttcccgttatggactcgctatctgtcaaccagatcttataccctgaagttcacctagatagcccgatagttaccaataagatagtagctatcctggagtatgctcgagtccctcacgcttacagcctggaggaccctacactgtgtcagaacatcaagcaccgcctaaaaaacggattctccaaccaaatgattataaacaatgtggaagttgggaatgtcatcaagtccaagcttaggagttatccggcccactctcatattccatatccaaattgtaatcaggatttatttaacatagaagacaaagagtcaacaaggaagatccgtgagctcctaaaaaagggaaattcgctgtactccaaagtcagtgataaggttttccaatgcctgagggacactaactcacggcttggcctaggctccgaattgagggaggacatcaaggagaaaattattaacttgggagtttacatgcacagctcccaatggtttgagccctttctgttttggtttacagtcaagactgagatgaggtcagtgattaaatcacaaacccatacttgccataggaggagacacacacctgtattcttcactggtagttcagttgagctgttaatctctcgtgaccttgttgctataatcagtaaggaatctcaacatgtatattacctgacgtttgaactggttttgatgtattgtgatgtcatagaggggaggttaatgacagagaccgctatgaccattgatgctaggtatgcagaacttctaggaagagtcagatacatgtggaaactgatagatggtttcttccctgcactcgggaatccaacttatcaaattgtagccatgctggagccactttcacttgcttacctgcaactgagggatataacagtagaactcagaggtgctttccttaaccactgctttactgaaatacatgatgttcttgaccaaaacgggttttctgatgaaggtacttatcatgagttaattgaagccctagattacattttcataactgatgacatacatctgacaggggagattttctcatttttcagaagtttcggccaccccagacttgaagcagtaacggctgctgaaaatgtcaggaaatacatgaatcagcctaaagtcattgtgtatgagactctgatgaaaggtcatgccatattttgtggaatcataatcaacggctatcgtgacaggcacggaggcagttggccacccctgaccctccccctgcatgctgcagacacaatccggaatgctcaagcttcaggtgaagggttaacacatgagcagtgcgttgataactggaaatcatttgctggagtgagatttggctgttttatgcctcttagcctggacagtgatctgacaatgtacctaaaggacaaggcacttgctgctctccaaagggaatgggattcagtttacccgaaagagttcctgcgttacgatcctcccaagggaaccgggtcacggaggcttgtagatgttttccttaatgattcgagctttgacccatatgatatgataatgtatgtcgtaagtggagcctacctccatgaccctgagttcaacctgtcttacagcctgaaagaaaaggagatcaaggaaacaggtagacttttcgctaaaatgacttacaaaatgagggcatgccaagtgatcgctgaaaatctaatctcaaacgggattggcaagtattttaaggacaatgggatggccaaggatgagcacgatttgactaaggcactccacactctggctgtctcaggagtccccaaagatctcaaagaaagtcacaggggggggccagtcttaaaaacctactcccgaagcccagtccacacaagtaccaggaacgttaaagcagaaaaagggtttgtaggattccctcatgtaattcggcagaatcaagacactgatcatccggagaatatagaaacctacgagacagtcagcgcatttatcacgactgatctcaagaagtactgccttaattggagatatgagaccatcagcttatttgcacagaggctaaatgagatttacggattaccctcattttttcagtggctgcataagaggcttgaaacctctgtcctctatgtaagtgaccctcattgcccccccgaccttgacgcccatgtcccgttatgcaaagtccccaatgaccaaatcttcatcaagtaccctatgggaggtatagaagggtattgtcagaagctgtggaccatcagcaccattccctacttatacctggctgcttatgagagcggggtaaggattgcttcgttagtgcaaggggacaatcagaccatagccgtaacaaaaagggtacccagcacatggccttacaaccttaagaaacgggaagctgctagagtaactagagattactttgtaattcttaggcaaaggctacatgacattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcggcatgcagtaatattgctacaacaatggccaaaagcattgagagaggttatgaccgttatcttgcatattccctgaacgtcctaaaagtgatacagcaaattttgatctcccttggcttcacaatcaattcaaccatgacccgggatgtagtcatacccctcctcacaaacaacgatctcttaataaggatggcactgttgcccgctcctattgggggtatgaattatctgaatatgagcaggctgtttgtcagaaacatcggtgatccagtaacatcatcaattgctgatctcaagagaatgattctcgcatcactaatgcctgaagagaccctccatcaagtaatgacacaacaaccgggggactcttcattcctagactgggctagcgacccttactcagcaaatcttgtatgcgtccagagcatcactagactcctcaagaacataactgcaaggtttgtcctgatccacagtccaaacccaatgttaaaagggttattccatgatgacagcaaagaagaggacgagagactggcggcattcctcatggacaggcatattatagtacctagggcagctcatgaaatcctggatcatagtgtcacaggggcaagagagtctattgcaggcatgctagataccacaaaaggcctgattcgagccagcatgaggaagggggggttaacctctcgagtgataaccagattgtccaattatgactatgaacaatttagagcagggatggtgctattgacaggaagaaagagaaatgtcctcattgacaaagagtcatgttcagtgcagctggctagagccctaagaagccatatgtgggcaagactagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagctcgccttcgtaagagccccaagtagatccttgcgatctgccgttagaatagcaacagtgtactcatgggcttacggtgatgatgatagctcttggaacgaagcctggttgttggcaaggcaaagggccaatgtgagcctggaggagctaagggtgatcactcccatctcgacttcgactaatttagcgcataggttgagggatcgtagcactcaagtgaaatactcaggtacatcccttgtccgagtggcaaggtataccacaatctccaacgacaatctctcatttgtcatatcagataagaaggttgatactaactttatataccaacaaggaatgcttctagggttgggtgttttagaaacattgtttcgactcgagaaagatactggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattctagctaagtccacagcactatctatgattgacctggtaacaaaatttgagaaggaccatatgaatgaaatttcagctctcataggggatgacgatatcaatagtttcataactgagtttctgcttatagagccaagattattcaccatctacttgggccagtgtgcagccatcaattgggcatttgatgtacattatcatagaccatcagggaaatatcagatgggtgagctgttgtcttcgttcctttctagaatgagcaaaggagtgtttaaggtgcttgtcaatgctctaagccacccaaagatctacaagaaattctggcattgtggtattatagagcctatccatggtccttcacttgatgctcaaaacttgcacacaactgtgtgcaacatggtttacacatgctatatgacctacctcgacctgttgttgaatgaagagttagaagagttcacatttcttttgtgtgaaagcgatgaggatgtagtaccggacagattcgacaacatccaggcaaaacacttgtgtgttctggcagatttgtactgtcaaccagggacctgcccaccgattcgaggtctaaggccggtagagaaatgtgcagttctaaccgatcatatcaaggcagaggctaggttatctccagcaggatcttcgtggaacataaatccaattattgtagaccattactcatgctctctgacttatctccgtcgaggatctatcaaacagataagattgagagttgatccaggattcatttttgacgccctcgctgaggtaaatgtcagtcagccaaaggtcggcagcgacgtcagccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaaatgcacactctgtatgctccaggtggctatgacatcatgggctatctggatcagatagggaatcgtcctaatccccaagtggaacttggaccagtagacactagctgtgcactgattctctgtgacctcaagcagaaggacacacccatcgtgtacgcctctgaagcgtttctgtacatgacaggctacagcaatgccgaagtcttggggagaaattgccgatttctgcagagtcctgacggtatggtcaaacccaagtcaacgaggaaatacgtcgattccaacaccatcaacaccattcggaaagccatcgatcggaatgctgaggtgcaagtggaggttgtgaacttcaagaagaacggacagaggttcgtgaacttcctgaccataattccggttagagatgagacaggagagtaccgctattccatggggttccagtgcgaaacagaatatccgtacgacgtcccagattacgcgggcatctcaaatatgagcatcaaggatttcagacctccacacgatgatgttgcaaaattgctcaaagatatcaacacaagcaagcacaatcttcccatttcagggggtagtctcgccaattatgaaatccatgctttccgcagaatcgggttaaactcatctgcttgctacaaagctgttgagatatcaacattaattaggagatgccttgagccaggggaagacggcttgttcttgggtgaggggtcgggttctatgttgatcacttataaggagatactaaaactaaacaagtgcttctataatagtggggtttccgccaattctagatctggtcaaagggaattagcaccctatccctccgaagttggccttgtcgaacacagaatgggagtaggtaatattgtcaaggtgctctttaacgggaggcccgaagtcacgtgggtaggcagtatagattgcttcaatttcatagtcagtaatatccctacctctagtgtggggtttatccattcagatatagagaccttacctaacaaagatactatagagaagctagaggaattggcagccatcttatcgatggctctactccttggcaaaataggatcaatactggtgattaagcttatgcctttcagcggggattttgttcagggatttataagctatgtagggtctcattatagagaagtgaaccttgtctaccctaggtacagcaacttcatatctactgaatcttatttagttatgacagatctcaaagctaaccggctaatgaatcctgaaaagatcaagcagcagataattgaatcatctgtacggacttcacctggacttataggtcacatcctatccattaagcaactaagctgcatacaagcaattgtgggaggcgcggttagtagaggtgatatcaaccctattctgaaaaaacttacacctatagagcaggtgctgatcagttgcgggttggcaattaacggacctaaactgtgcaaagaattaatccaccatgatgttgcctcagggcaagatggattgcttaactctatactcatcctctacagggagttggcaagattcaaagacaaccaaagaagtcaacaagggatgttccacgcttaccccgtattggtaagtagtaggcaacgagaacttgtatctaggatcactcgcaaattttgggggcatattcttctttactccgggaacagaaagttgataaatcggtttatccagaatctcaagtccggttatctagtactagacttacaccagaatatcttcgttaagaatctatccaagtcagagaaacagattattatgacggggggtttaaaacgtgagtgggtttttaaggtaacagtcaaggagaccaaagaatggtacaagttagtcggatacagcgctctgattaaggattaattggttgaactccggaaccctaatcctgccctaggtagttaggcattatttgcaatatattaaagaaaactttgaaaatacgaagtttctattcccagctttgtctggtggccggcatggtcccagcctcctcgctggcgccggctgggcaacattccgaggggaccgtcccctcggtaatggcgaatgggacgcggccgccgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgccagtgaattgtaatacgactcactata

SEQ ID NO: 83 - DNA, 20678 bp, Artificial Sequence
  p(+)MV323-pMag-linker-nMag
accaaacaaagttgggtaaggatagatcaatcaatgatcatattctagtacacttaggattcaagatcctattatcagggacaagagcaggattagggatatccgagggcgcgccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaagacgtcgagaggccgaggaccagaacaacatccgcctaccctccatcattgttataaaaaacttaggaaccaggtccacacagccgccagccaaccaaccatccactcccacgactggagttcgaacgagatggccacacttttgaggagcttagcattgttcaaaagaaacaaggacaaaccacccattacatcaggatccggtggagccatcagaggaatcaaacacattattatagtaccaattcctggagattcctcaattaccactcgatccagactactggaccggttggtcaggttaattggaaacccggatgtgagcgggcccaaactaacaggggcactaataggtatattatccttatttgtggagtctccaggtcaattgattcagaggatcaccgatgaccctgacgttagcatcaggctgttagaggttgttcagagtgaccagtcacaatctggccttaccttcgcatcaagaggtaccaacatggaggatgaggcggaccaatacttttcacatgatgatccaagcagtagtgatcaatccaggtccggatggttcgagaacaaggaaatctcagatattgaagtgcaagaccctgagggattcaacatgattctgggtaccattctagcccagatctgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctctttacgccgattcatggtggctctaatcctggatatcaagaggacacccgggaacaaacctaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaatctttaccagcaaatgggagaaactgcaccctacatggtaatcctagagaactcaattcagaacaagttcagtgcaggatcataccctctgctctggagctatgccatgggagtaggagtggaacttgaaaactccatgggaggtttgaactttggtcgatcttactttgatccagcatattttagattagggcaagagatggtgaggaggtcagctggaaaggtcagttccacattggcatccgaactcggtatcactgccgaggatgcaaggcttgtttcagagattgcaatgcatactactgaggacaggatcagtagagcggtcggacccagacaagcccaagtgtcatttctacacggtgatcaaagtgagaatgagctaccaggattggggggcaaggaagataggagggtcaaacagggtcggggagaagccagggagagctacagagaaaccgggtccagcagagcaagtgatgcgagagctgcccatcctccaaccagcatgcccctagacattgacactgcatcggagtcaggccaagatccgcaggacagtcgaaggtcagctgacgccctgctcaggctgcaagccatggcaggaatcttggaagaacaaggctcagacacggacacccctagggtatacaatgacagagatcttctagactaggtgcgagaggccgaggaccagaacaacatccgcctaccctccatcattgttataaaaaacttaggaaccaggtccacacagccgccagccaaccaaccatccactcccacgactggagccgatggcagaagagcaggcacgccatgtcaaaaacggactggaatgcatccgggctctcaaggccgagcccatcggctcactggccgtcgaggaagccatggcagcatggtcagaaatatcagacaacccaggacaggaccgagccacctgcaaggaagaggaggcaggcagttcgggtctcagcaaaccatgcctctcagcaattggatcaactgaaggcggtgcacctcgcatccgcggtcagggatctggagaaagcgatgacgacgctgaaactttgggaatcccctcaagaaatctccaggcatcaagcactgggttacagtgttatcatgtttatgatcacagcggtgaagcggttaagggaatccaagatgctgactctatcatggttcaatcaggccttgatggtgatagcaccctctcaggaggagacgatgaatctgaaaacagcgatgtggatattggcgaacctgataccgagggatatgctatcactgaccggggatctgctcccatctctatggggttcagggcttctgatgttgaaactgcagaaggaggggagatccacgagctcctgaaactccaatccagaggcaacaactttccgaagcttgggaaaactctcaatgttcctccgcccccgaaccccagtagggccagcacttccgagacacccattaaaaagggcacagacgcgagattggcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctccgatgtccaagacatcaaaacagccttggccaaaatacacgaggataatcagaagataatctccaagctagaatcattgctgttattgaagggagaagttgagtcaattaagaagcagatcaacaggcaaaatatcagcatatccaccctggaaggacacctctcaagcatcatgattgccattcctggacttgggaaggatcccaacgaccccactgcagatgtcgaactcaatcccgacctgaaacccatcataggcagagattcaggccgagcactggccgaagttctcaagaagcccgttgccagccgacaactccagggaatgactaatggacggaccagttccagaggacagctgctgaaggaatttcaactaaagccgatcgggaaaaaggtgagctcagccgtcgggtttgttcctgacaccggccctgcatcacgcagtgtaatccgctccattataaaatccagccggctagaggaggatcggaagcgttacctgatgactctccttgatgatatcaaaggagccaacgatcttgccaagttccaccagatgctgatgaagataataatgaagtagctacagctcaacttacctgccaaccccatgccagtcgacctaattagtacaacctaaatccattataaaaaacttaggagcaaagtgattgcctcctaagttccacaatgacagagatctacgatttcgacaagtcggcatgggacatcaaagggtcgatcgctccgatacaacctaccacctacagtgatggcaggctggtgccccaggtcagagtcatagatcctggtctaggtgataggaaggatgaatgctttatgtacatgtttctgctgggggttgttgaggacagcgatcccctagggcctccaatcgggcgagcattcgggtccctgcccttaggtgttggtagatccacagcaaaacccgaggaactcctcaaagaggccactgagcttgacatagttgttagacgtacagcagggctcaatgaaaaactggtgttctacaacaacaccccactaaccctcctcacaccttggagaaaggtcctaacaacagggagtgtcttcaatgcaaaccaagtgtgcaatgcggttaatctaataccgctggacaccccgcagaggttccgtgttgtttatatgagcatcacccgtctttcggataacgggtattacaccgttcccagaagaatgctggaattcagatcggtcaatgcagtggccttcaacctgctagtgacccttaggattgacaaggcgattggccctgggaagatcatcgacaatgcagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccactgatggatatcaatgaagaccttaatcggttactctggaggagcagatgcaagatagtaagaatccaggcagttttgcagccatcagttcctcaagaattccgcatttacgacgacgtgatcataaatgatgaccaaggactattcaaagttctgtagaccgcagtgcccagcaatacccgaaaacgacccccctcataatgacagccagaaggcccggacaaaaaagccccctccagaagactccacggaccaagcgagaggccagccagcagccgacagcaagtgtggacaccaggcggcccaagcacagaacagccccgacacaaggccaccaccagccatcccaatctgcgtcctcctcgtgggacccccgaggaccaaccccgaaggtcgctccgaacacagaccaccaaccgcatccccacagctcccgggaaaggaacccccagcaactggaaggcccctccccccctcccccaacgcaagaaccccacaaccgaaccgcacaagcgaccgaggtgacccaaccgcaggcatccgactccttagacagatcctctccccccggcatactaaacaaaacttagggccaaggaacacacacactcgacagaacccagaccccggcccgcggcaccgcgcccccaccccccgaaaaccagagggagcccccaaccaaacccgccggcccccccggtgcccacaggtaggcacaccaacccccgaccagacccagcacccagccaccgacaatccaagacggggggccccccccaaaaaaaggcccccaggggccgacagccagcatcgcgaggaagcacacccaccccacacacgaccacggcaaccgaaccagagtccagaccaccctgggccaccagctcccagactcggccatcaccccgcaaaaaggaaaggccacaacccgcgcaccccagccccgatccggcgggcagccactcaacccgaaccagcacccaagagcgatccctgggggacccccaaaccgcaaaagacatcagtatcccacagcctctccaagtcccccggtctcctcctcttctcgaagggaccaaaagatcaatccaccacatccgacgacactcaattccccacccccaaaggagacaccgggaatcccagaatcaagactcatccagtgtccatcatgggtctcaaggtgaacgtctctgccatattcatggcagtactgttaactctccaaacacccaccggtcaaatccattggggcaatctctctaagataggggtggtagggataggaagtgcaagctacaaagttatgactcgttccagccatcaatcattggtcataaaattaatgcccaatataactctcctcaataactgcacgagggtagagatcgcagaatacaggagactactgagaacagttttggaaccaattagagatgcacttaatgcaatgacccagaatataagaccggttcagagtgtagcttcaagtaggagacacaagagatttgcgggagttgtcctggcaggtgcggccctaggcgttgccacagctgctcagataacagccggcattgcacttcaccagtccatgctgaactctcaagccatcgacaatctgagagcaagcctggaaactactaatcaggcaattgaggcaatcagacaagcagggcaggagatgatattggctgttcagggtgtccaagactacatcaataatgagctgataccgtctatgaaccaactatcttgtgatttaatcggccagaagctagggctcaaattgctcagatactatacagaaatcctgtcattatttggccccagcttacgggaccccatatctgcggagatatccatccaggctttgagctatgcgcttggaggagatatcaataaggtattagaaaagctcggatacagtggaggtgatttactgggcatcttagagagcagaggaataaaggcccggataactcacgtcgacacagagtcctacttcattgtactcagtatagcctatccgacgctgtccgagattaagggggtgattgtccaccggctagagggggtctcgtacaatataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtccaccaagtcctgtgctcgtacactcgtatccgggtcttttgggaaccggttcattttatcacaagggaacctaatagccaattgtgcatcaatcctctgcaagtgttacacaacaggaacgatcattaatcaagaccctgacaagatcctaacatacattgctgccgatcactgcccggtggtcgaggtgaacggtgtgaccatccaagtcgggagcaggaggtatccggacgcggtgtacctgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtttacatcctgattgcagtgtgtcttggagggttgatagggatccccgctttaatatgttgctgcagggggcgctgtaacaaaaagggagaacaagttggtatgtcaagaccaggcctaaagcctgatcttacagggacatcaaaatcctatgtaaggtcgctctgatcctctacaactcttgaaacacagatttcccacaagtctcctcttcgtcatcaagcaaccaccgcatccagcatcaagcccacctgaaattgtctccggcttccctctggccgaacgatatcggtagttaattaaaacttagggtgcaagatcatccacaatgtcaccacaacgagaccgaataaatgccttctacaaagacaacccacatcctaagggaagtaggatagttattaacagagaacatcttatgattgatagaccttatgttttgctggctgttctattcgtcatgtttctgagcttgatcgggttgctagccattgcaggcattagactccatcgtgcagccatctacaccgcagagatccataagagcctcagcaccaatctagatgtaactaactcgatcgagcatcaggtcaaggacgtgctgacaccactcttcaagatcattggtgatgaagtgggcctgaggacacctcagagattcactgacctagtgaaattcatctctgacaaaattaaattccttaatccggatagggagtacgacttcagagatctcacttggtgtatcaacccgccagagagaatcaaattggattatgatcaatactgtgcagatgtggctgctgaagaactcatgaatgcattggtgaactcaactctactggaggccagggcaaccaatcagttcctagctgtctcaaagggaaactgctcagggcccactacaatcagaggtcaattctcaaacatgtcgctgtccctgttggacttgtatttaagtcgaggttacaatgtgtcatctatagtcactatgacatcccagggaatgtacgggggaacttacctagtgggaaagcctaatctgagcagtaaagggtcagagttgtcacaactgagcatgcaccgagtgtttgaagtaggggttatcagaaatccgggtttgggggctccggtgttccatatgacaaactattttgagcaaccagtcagtaatgatttcagcaactgcatggtggctttgggggagcttaaattcgcagccctctgtcacagggaagattctatcacaattccctatcaggggtcagggaaaggtgtcagcttccagctcgtcaagctaggtgtctggaaatccccaaccgacatgcgatcctgggtccccctatcaacggatgatccagtgatagataggctttatctctcatctcacagaggtgttatcgctgacaatcaagcaaaatgggctgtcccgacaacacggacagatgacaagttgcgaatggagacatgcttccagcaggcgtgtaagggtaaaaaccaagcactctgcgagaatcccgagtgggcaccattgaaggataacaggattccttcatacggggtcttgtctgttaatctgagtctgacagttgagcttaaaatcaaaattgcttcaggattcgggccattgatcacacacggttcagggatggacctatacaaaaccaaccacaacaatgtgtattggctgactatcccgccaatgaagaacctagccttaggtgtaatcaacacattggagtggataccgagattcaaggttagtcccaacctcttcactgttccaatcaaggaagcaggcgaggactgccatgccccaacatacctacctgcggaggtggatggtgatgtcaaactcagttccaatctggtaattctacctggtcaggatctccaatatgttttggcaacctacgatacttccagggttgaacatgctgtggtttattatgtttacagcccaagccgctcattttcttacttttatccttttaggttgcctataaagggggtcccaatcgaattacaagtggaatgcttcacatgggacaaaaaactctggtgccgtcacttctgtgtgcttgcggactcagaatctggtggacatatcactcactctgggatggtgggcatgggagtcagctgcacagtcactcgggaagatggaaccaatcgcagatagggctgccagtgaaccgatcacatgatgtcacccagacatcaggcatacccactagtgtgaaatagacatcagaattaagaaaaacgtagggtccaagtggtttcccgttatggactcgctatctgtcaaccagatcttataccctgaagttcacctagatagcccgatagttaccaataagatagtagctatcctggagtatgctcgagtccctcacgcttacagcctggaggaccctacactgtgtcagaacatcaagcaccgcctaaaaaacggattctccaaccaaatgattataaacaatgtggaagttgggaatgtcatcaagtccaagcttaggagttatccggcccactctcatattccatatccaaattgtaatcaggatttatttaacatagaagacaaagagtcaacaaggaagatccgtgagctcctaaaaaagggaaattcgctgtactccaaagtcagtgataaggttttccaatgcctgagggacactaactcacggcttggcctaggctccgaattgagggaggacatcaaggagaaaattattaacttgggagtttacatgcacagctcccaatggtttgagccctttctgttttggtttacagtcaagactgagatgaggtcagtgattaaatcacaaacccatacttgccataggaggagacacacacctgtattcttcactggtagttcagttgagctgttaatctctcgtgaccttgttgctataatcagtaaggaatctcaacatgtatattacctgacgtttgaactggttttgatgtattgtgatgtcatagaggggaggttaatgacagagaccgctatgaccattgatgctaggtatgcagaacttctaggaagagtcagatacatgtggaaactgatagatggtttcttccctgcactcgggaatccaacttatcaaattgtagccatgctggagccactttcacttgcttacctgcaactgagggatataacagtagaactcagaggtgctttccttaaccactgctttactgaaatacatgatgttcttgaccaaaacgggttttctgatgaaggtacttatcatgagttaattgaagccctagattacattttcataactgatgacatacatctgacaggggagattttctcatttttcagaagtttcggccaccccagacttgaagcagtaacggctgctgaaaatgtcaggaaatacatgaatcagcctaaagtcattgtgtatgagactctgatgaaaggtcatgccatattttgtggaatcataatcaacggctatcgtgacaggcacggaggcagttggccacccctgaccctccccctgcatgctgcagacacaatccggaatgctcaagcttcaggtgaagggttaacacatgagcagtgcgttgataactggaaatcatttgctggagtgagatttggctgttttatgcctcttagcctggacagtgatctgacaatgtacctaaaggacaaggcacttgctgctctccaaagggaatgggattcagtttacccgaaagagttcctgcgttacgatcctcccaagggaaccgggtcacggaggcttgtagatgttttccttaatgattcgagctttgacccatatgatatgataatgtatgtcgtaagtggagcctacctccatgaccctgagttcaacctgtcttacagcctgaaagaaaaggagatcaaggaaacaggtagacttttcgctaaaatgacttacaaaatgagggcatgccaagtgatcgctgaaaatctaatctcaaacgggattggcaagtattttaaggacaatgggatggccaaggatgagcacgatttgactaaggcactccacactctggctgtctcaggagtccccaaagatctcaaagaaagtcacaggggggggccagtcttaaaaacctactcccgaagcccagtccacacaagtaccaggaacgttaaagcagaaaaagggtttgtaggattccctcatgtaattcggcagaatcaagacactgatcatccggagaatatagaaacctacgagacagtcagcgcatttatcacgactgatctcaagaagtactgccttaattggagatatgagaccatcagcttatttgcacagaggctaaatgagatttacggattaccctcattttttcagtggctgcataagaggcttgaaacctctgtcctctatgtaagtgaccctcattgcccccccgaccttgacgcccatgtcccgttatgcaaagtccccaatgaccaaatcttcatcaagtaccctatgggaggtatagaagggtattgtcagaagctgtggaccatcagcaccattccctacttatacctggctgcttatgagagcggggtaaggattgcttcgttagtgcaaggggacaatcagaccatagccgtaacaaaaagggtacccagcacatggccttacaaccttaagaaacgggaagctgctagagtaactagagattactttgtaattcttaggcaaaggctacatgacattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcggcatgcagtaatattgctacaacaatggccaaaagcattgagagaggttatgaccgttatcttgcatattccctgaacgtcctaaaagtgatacagcaaattttgatctcccttggcttcacaatcaattcaaccatgacccgggatgtagtcatacccctcctcacaaacaacgatctcttaataaggatggcactgttgcccgctcctattgggggtatgaattatctgaatatgagcaggctgtttgtcagaaacatcggtgatccagtaacatcatcaattgctgatctcaagagaatgattctcgcatcactaatgcctgaagagaccctccatcaagtaatgacacaacaaccgggggactcttcattcctagactgggctagcgacccttactcagcaaatcttgtatgcgtccagagcatcactagactcctcaagaacataactgcaaggtttgtcctgatccacagtccaaacccaatgttaaaagggttattccatgatgacagcaaagaagaggacgagagactggcggcattcctcatggacaggcatattatagtacctagggcagctcatgaaatcctggatcatagtgtcacaggggcaagagagtctattgcaggcatgctagataccacaaaaggcctgattcgagccagcatgaggaagggggggttaacctctcgagtgataaccagattgtccaattatgactatgaacaatttagagcagggatggtgctattgacaggaagaaagagaaatgtcctcattgacaaagagtcatgttcagtgcagctggctagagccctaagaagccatatgtgggcaagactagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagctcgccttcgtaagagccccaagtagatccttgcgatctgccgttagaatagcaacagtgtactcatgggcttacggtgatgatgatagctcttggaacgaagcctggttgttggcaaggcaaagggccaatgtgagcctggaggagctaagggtgatcactcccatctcgacttcgactaatttagcgcataggttgagggatcgtagcactcaagtgaaatactcaggtacatcccttgtccgagtggcaaggtataccacaatctccaacgacaatctctcatttgtcatatcagataagaaggttgatactaactttatataccaacaaggaatgcttctagggttgggtgttttagaaacattgtttcgactcgagaaagatactggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattctagctaagtccacagcactatctatgattgacctggtaacaaaatttgagaaggaccatatgaatgaaatttcagctctcataggggatgacgatatcaatagtttcataactgagtttctgcttatagagccaagattattcaccatctacttgggccagtgtgcagccatcaattgggcatttgatgtacattatcatagaccatcagggaaatatcagatgggtgagctgttgtcttcgttcctttctagaatgagcaaaggagtgtttaaggtgcttgtcaatgctctaagccacccaaagatctacaagaaattctggcattgtggtattatagagcctatccatggtccttcacttgatgctcaaaacttgcacacaactgtgtgcaacatggtttacacatgctatatgacctacctcgacctgttgttgaatgaagagttagaagagttcacatttcttttgtgtgaaagcgatgaggatgtagtaccggacagattcgacaacatccaggcaaaacacttgtgtgttctggcagatttgtactgtcaaccagggacctgcccaccgattcgaggtctaaggccggtagagaaatgtgcagttctaaccgatcatatcaaggcagaggctaggttatctccagcaggatcttcgtggaacataaatccaattattgtagaccattactcatgctctctgacttatctccgtcgaggatctatcaaacagataagattgagagttgatccaggattcatttttgacgccctcgctgaggtaaatgtcagtcagccaaaggtcggcagcgacgtcagccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaaaccggtaattccgctgacggcggcggaggatcgggtggtagtggtggttcaggaggaggatcgacccaaggaggatccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatatccgtacgacgtcccagattacgcgggcatctcaaatatgagcatcaaggatttcagacctccacacgatgatgttgcaaaattgctcaaagatatcaacacaagcaagcacaatcttcccatttcagggggtagtctcgccaattatgaaatccatgctttccgcagaatcgggttaaactcatctgcttgctacaaagctgttgagatatcaacattaattaggagatgccttgagccaggggaagacggcttgttcttgggtgaggggtcgggttctatgttgatcacttataaggagatactaaaactaaacaagtgcttctataatagtggggtttccgccaattctagatctggtcaaagggaattagcaccctatccctccgaagttggccttgtcgaacacagaatgggagtaggtaatattgtcaaggtgctctttaacgggaggcccgaagtcacgtgggtaggcagtatagattgcttcaatttcatagtcagtaatatccctacctctagtgtggggtttatccattcagatatagagaccttacctaacaaagatactatagagaagctagaggaattggcagccatcttatcgatggctctactccttggcaaaataggatcaatactggtgattaagcttatgcctttcagcggggattttgttcagggatttataagctatgtagggtctcattatagagaagtgaaccttgtctaccctaggtacagcaacttcatatctactgaatcttatttagttatgacagatctcaaagctaaccggctaatgaatcctgaaaagatcaagcagcagataattgaatcatctgtacggacttcacctggacttataggtcacatcctatccattaagcaactaagctgcatacaagcaattgtgggaggcgcggttagtagaggtgatatcaaccctattctgaaaaaacttacacctatagagcaggtgctgatcagttgcgggttggcaattaacggacctaaactgtgcaaagaattaatccaccatgatgttgcctcagggcaagatggattgcttaactctatactcatcctctacagggagttggcaagattcaaagacaaccaaagaagtcaacaagggatgttccacgcttaccccgtattggtaagtagtaggcaacgagaacttgtatctaggatcactcgcaaattttgggggcatattcttctttactccgggaacagaaagttgataaatcggtttatccagaatctcaagtccggttatctagtactagacttacaccagaatatcttcgttaagaatctatccaagtcagagaaacagattattatgacggggggtttaaaacgtgagtgggtttttaaggtaacagtcaaggagaccaaagaatggtacaagttagtcggatacagcgctctgattaaggattaattggttgaactccggaaccctaatcctgccctaggtagttaggcattatttgcaatatattaaagaaaactttgaaaatacgaagtttctattcccagctttgtctggtggccggcatggtcccagcctcctcgctggcgccggctgggcaacattccgaggggaccgtcccctcggtaatggcgaatgggacgcggccgccgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgccagtgaattgtaatacgactcactata

SEQ ID NO: 84 - DNA, 16914 bp, Artificial Sequence
  pHEP-pMag-direct-nMaghigh
acgcttaacaacaaaaccaaagaagaagcagacatcgtcagttgcaaagcaaaaatgtaacacccctacaatggatgccgacaagattgtgttcaaagtcaataaccgggtggtctctttgaagcccgagattatcgtggatcaatatgagtacaagtaccctgctatcaaagatttgaaaaagccttgtataaccctagggaaagcccccgatttaaacaaagcttacaaatcagttttatcaggcatgaatgccgccaaacttgatcctgatgatgtatgctcctacttggcagcagcaatgcagttctttgaggggacatgtccggaagactggaccagctatggaatcctgattgcacgaaaaggagacaagatcaccccagactctctagtggagataaagcgtactgatgtagaagggaattgggctctgacaggaggcatggaactgacaagggaccccactgtctctgaacatgcatctttagtcggtcttctcctgagtctgtacagattgagcaaaatatcaggacaaaacactggtaactataagacaaacattgcggatagaatagagcagattttcgagacagccccttttgttaagatcgtggaacaccacaccctgatgacaactcacaagatgtgtgctaattggagtactataccgaacttcagatttttggccggaacctacgacatgtttttctcacggatcgagcatctgtattcggcaatcagagtgggcacagttgtcaccgcttatgaagactgctcaggactggtatcgtttacagggttcataaagcagatcattctcaccgcaagagaagcaatactatatttcttccacaagaactttgaagaagagataaggagaatgtttgagccagggcaagagacagctgttcctcactcttatttcatccacttccgttcactaggcttgagtgggaagtctccttattcatcaaatgccgtcggtcatgtgttcaatctcattcactttgttggatgctatatgggtcaagtcagatctctaaatgccacggttattgctgcatgtgcccctcatgagatgtctgttctagggggctatttgggagaggagttcttcggaaaagggacatttgaaagaaggttcttcagagacgagaaagaacttcaagaatatgaggcggctgaactgacaaagaccgacgtggcactggcagatgacggaactgtcaactccgatgacgaggactacttctccggtgaaaccagaagtcctgaagctgtctatactcgaatcatgatgaatggaggtcgactgaagagatcacatatacggagatatgtctcagtcagttccaatcatcaagcccgtccaaactcattcgccgaatttttaaacaaaacgtattcgagtgactcataaggagttgaatgacagggtgccagaaatccatagattgtgtatatccatcatgaaaaaaactaacactcctcctttcgaaccatcccaagtatgagcaagatctttgttaatccgagtgcaatcagagccggtctggccgatcttgagatggccgaagagactgttgatctgatcaacagaaacatagaagacaatcaggctcatctccagggagaacccatagaagtggacaatctccctgaggacatgaggcaatttcacctggacgatgaaaaattgtccaaccttggtgagatggttagggtgggcgaaggcaagtatcgagaggactttcagatgaatgagggagaggaccccaacctcctgttccaatcgtacctggacaatgttggagtccaaatagtcagacaaatgaggtcaggagagagattcctcaagatatggtcacagaccgtagaggaaattatatcctatgtctcggtcaactttcctaaccctccaggaaggtcttcggaggataaatcaacccaaactactggccgggagctcaagaaggagacaacatccattctttctcaaagagaaagccaaccttcaaaagccggaatggtggctcaagttgcctctggccctccatcccttgaatggtctgccaccaatggagaggatgatctatcagtagaggctgagatcgctcatcagattgctgaaagcttttccaagaagtacaagtttccttctcgatcttcaggaatattcttgtataattttgagcaactggagatgaaccttgatgacatagttaaagaggcaaaaaatgtaccgggcgtgacccgtctggcccatgatggatccaaaatccccctaagatgtgtactgggatgggtcgctttggccaactccaagaaattccaattgctagtcgaggccgacaagctaagcaaaatcatgcaagatgacttggatcgctacacatcatgctaaccgagtcttcgaattcattccctctagataatgaaaactgagatgtcatggagtcgatatgaaaaaaacaggcaacaccactaataaaatgaactttctatgtaagatagtgaaaaactgtagggatgaggacacccaaaagccctctcccgcgtcagcccctccggatggcgatgacctgtggcttccacctccagaatatgtcccgctgaaagaactcacaagcaagaagaacatgaggaacttttgtatcaacggggaggttaaagtgtgcagtccgaacggttactcattcaggatcctgcggcatattctgagatcattcgacgagatatactctgggaatcataggatgattgggttagtcaaagttgttgttggactagctttatcaggagctccagctcctgagggcatgaactgggtatacaaattgaggagaacccttattttccagtgggctgattccaggggccctcttgaaggggaggagttggaacactctcaagagatcacttgggacgatgatactgaattcgtcggattgcaaatgagagtgagcgcaagacaatgtcatattcaaggcaggatctggtgtatcgacatgaactcgagggcatgtcaactatggtctgacatgtctcttcagacacaaaggtctgaagaggacaaagactcttctctgcttttagaataatcagataatatcccgcaagttcatcacttgtttacttctggaggagagaacatacgggcttaactccaatccttgggagcaatagaacaaaaaaacacgttatgatgccattaaaccgctgcattttatcaaagtcaagttaattaccgttacattttgagcctcttggatgtgaaaaaaactattaacatccctcaaaagacttaaggaaagatggttcctcaggttcttttgtttgcacccctcctggtttctccattgtgtttcgggaagttccccatttacacgataccagacaaacttggtccctggagccctattgacttacaccatctcagctgtccaaataacctggttgtggaggacgaaggatgtaccaacctgtccgggttctcttacatggaacttaaagtgggatacatctcagccataaaagtgaacgggttcacttgcacaggtgttgtgacagaggcagaaacctacaccaactttgttggttatgtcacaaccacattcaagagaaagcatttccgccccaccccagacgcatgtagagccgcgtataactggaagatggccggtgaccccagatatgaagagtctctacacaatccgtaccccgactaccattggcttcgaactgtaaaaaccaccaaagagtctctcgttatcatatccccaagtgtgacagatttggacccatatgacaaatcccttcactcaagggtcttccctggcggaaattgctcaggaataacggtgtcctcgacctactgctcaactaatcatgattacaccatctggatgcctgagaatctgagactagggacatcttgtgacatttttacccatagcagagggaagagagcatccaaaggagacaagacttgcggctttgtggatgaaagaggcctgtataagtctttaaagggagcatgcaaactcaagttatgtggagttctcggacttagacttatggatggaacatgggtcgcgatgcaaacatcagatgagaccaaatggtgccctccaggtcagttggtgaatttgcacgactttcgctcagacgagattgagcatctcgttgaggaagagttagtcaagaaaagagaggagtgtctggatgcactagagtccatcatgaccaccaagtcagtgagtttcagacgtctcagtcacctgagaaaacttgtccctgggtttggaaaagcatataccatattcaacaaaaccttgatggaggctgatgctcactacaagtctgtccagacctggaatgagatcatcccctcaaaagggtgtttgagagttggggagaggtgtcatccccatgtgaacggggtgtttttcaatggtataatattagggtctgacggccatgttctaatcccagagatgcagtcatccctcctccagcaacatatggagttgttggaatcttcagttatccccctgatgcaccccttggcagacccttctacagttttcaaagacggtgatgaggttgaggattttgttgaagttcacctccccgatgtgcataaacaggtctcaggagttgacctgggtctcccgaaatgggggaagtatgtattgatgattgcaggggccttgattgccctgatgttgataattttcctgatgacatgttgcagaagagtcaatcgaccagaatctacacaaagcaatcttggagggacagggagaaatgtgtcagtcccttcccaaagcggaaaagtcatatcttcatgggagtcatataagagtggaggcgagaccagactgtgaaggccggtcatccttttgacacctcaagtccagaggataacctcctcccggggaaaaaaactaacacctctcgtacgaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaactgcagtttgctagcaggaccggtacataactataaagggctgggtcatctaagcatttcagtcgagaaaaaaactgtataccaaaagaacaactaacaacacttctcatctcgagacccatatcaagatgctggatccgggagaggtttatgatgaccctattgatccaattgagtcagaggctgaacccagaggaacccccactgtccccaacatcttgaggaactctgactacaatctcaactctcctttgattgaggactctgccaaactaatgttagaatggttgaaaacagggaacagaccttatcggatgactttgacagacaattgctccaggtcttacaaagatttgaaagattatttcaagaaagtagatttgggttctctcaaagtgggaggaactgctgcacaatcaatgatttctctctggttgtatggagcccactctgagtcaaacaggagccggagatgtataaccgacttggcccatttctattccaagtcatcccccatagagaagctgttgaattgtacgttaggaaacagaggcctgagaatcccaccagagggggtgttaagttgccttgagagggtcgattatgataaggcatttgggaggtatctggccaacacgcattcctcttatctgtttttccatgtaattaccttatacatgaatgccctagactgggaagaggaaaaaaccatcctagcattatggaaagatctaacctcagtggacaccgggaaggacttggtcaaattcaaagatcaaatatggggactgctgattgtgacaaaggactttgtttactctcagagttctaactgtctttttgacagaaactatacactgatgctaaaggatcttttcttgtctcgattcaactccttgatgattttgctttctccccctgagccccgatactcagatgacttaatatctcagctgtgccagctatacatcgctggggatcaagtcttgtccttgtgtgggaactccggctatgaagtcatcaaaatattggagccatatgtcgtgaacagtttggtccagagggcagagaagtttaggcctctcatccactccttgggagactttcctatgtttataaaagacaaggtgaatcaacttgaagggactttcggtcccagtgcaaaaaggttttttagggttctagatcaattcgacaacatacatgatctagtatttgtgtatggctgttacagacattgggggcacccctatatagattatcggaagggtctgttgaaactatatgatcaagttcacattaagaaagtaatagataagtcctaccaggagtgtttagcaagtgacttggctagaaggatcctcagatggggatttgacaagtactccaagtggtatctagattcgagattccttgcccgagaccaccccttggctccttatatcaagacccaaacatggccacccaaacatatagtagacttggtgggggacacatggcacaagctcccgatcacgcagatctttgagattcctgaatcaatggacccgtcagagatactggatgataaatcacattctttcaccagaacaagactagcttcttggctgtcagagaaccgaggggggcctgttcctagcgagaaggtcattatcacggccctgtctcagccacctgtcaatccccgagagtttttgaaatctatcgacctcggaggattgccagatgatgacttgataattggcctcagaccaaaggaacgggagttgaagattgagggccgattcttcgctctaatgtcatggaatctaagattatattttgtcatcaccgagaagctcttggccaactacattttgccactttttgacgcactgactatgacagacaacctgaacaaggtatttaaaaagttgatcgacagggtcaccgggcaagggcttttggactattcgagggtcacttacgcatttcacctggactatgagaaatggaacaatcatcaaagattggagtcaacggaggatgtattttctgtcctagatcaggtgtttggattgaagagggtgttttctagaacacacgagttttttcagaagtcctggatctattattcagacagatcagacctcattgggttacgggaggatcagatatattgcttggatatgtccaatggtccaacctgctggaatggccaagacggcgggctagagggcttacggcagaagggctggagtctagtcagcttattgatgatagatagagaatctcaaaccaggaacacaagaaccaagatactagctcaaggagacaaccaggttctgtgtccgacatacatgttgtcaccgggattgtctcaagaggggcttctctatgagttagagagcatatcgaggaatgcactctcaatataccgagctatcgaggaaggagcatctaaactggggctgatcatcaagaaagaagagaccatgtgtagttatgactttctcatatatgggaagacccccttatttcgaggcaacatattagtacctgaatccaaaagatgggcccgagtctcttgcatctctaacgaccaaatagtcaacctcgccaatataatgtctacagtatccaccaatgcgctgacagtggcacaacactctcaatctctgatcaaacctatgagggattttctgctcatgtcagtacaggcagttttccactacctgctgtttagcccaatcttaaaaggcagggtttataagattctgagtgctgaaggggagagctttctcctagccatgtcgcggataatctatctagatccttctttgggaggggtgtctggaatgtctctcgggaggttccatatacgtcagttctcagaccctgtctctgaagggttgtcattctggagagagatctggttaagctcccacgaatcctggattcacgcgttgtgtcaagaggccgggaaccccgatcttggagagagaacactagagagcttcactcgccttttagaagatcctactaccttaaatatcaaaggaggggccagtcctaccattctactcaaggatgctatcagaaaggctctgtacgacgaggtggacaaggtggaaaattcagagtttcgagaggcaatcctgttgtccaagacccatagagataactttatactctttttaaaatctgttgagcctctgttccctcgatttctcagtgaactcttcagttcgtccttcttgggaataccagagtcaattattggactgatacaaaactccaggacaataagaaggcagtttagaaagagtctctcaagaactttagaagagtccttctacaactcagagatccacgggattaatcggatgacccagacacctcaaagggtcgggagagtgtggccctgctcttcagagagggcagatctacttagggagatctcttggggaaggaaagtggtgggcacgacagttcctcacccttccgagatgttggggctgcttccaaaatcctctatttcctgcacttgtggagcaacagggggaggcaatcctagagtttctgtatcagtactcccgtccttcgatcagtcatttttttcacgaggtcctctaaagggatacttgggctcgtccacctccatgtcaacccagctattccatgcatgggaaaaagtcactaatgttcatgtggtgaaaagggctatatcgttaaaagaatctataaactggttcatcaatagaaattccaatttggctcaaactctaattagaaacatcatgtctctgacaggccctgatttctctctagaagaggctcctgttttcaaacggacagggtcagccttgcataggttcaagtctgccagatacagcgaaggagggtattcttctgtttgtcctaaccttctctctcatatctctgtcagtacagacactatgtctgatttgacccaagacgggaagaactatgatttcatgtttcagccattgatgctttatgcgcaaacatggacatcagagctggtacagagagacacaagactgagagactccacgtttcactggcaccttcgatgcaacagatgtgtaaggcccattgaggatataacactggaaacttctcagatcttcgagttcccggatgtgtcaaaaaggatatccaggatggtttctggagccgtccctcactttcagaagcttcctgatatccgtctaagaccaggtgattttgaatctctaagtggtagagaaaagtctcgccacatagggtcagctcaggggctcttatactcaatcttagtagcaattcacgattcaggatacaatgatgggaccatcttccctgtcaacatatacggcaaggtttcccctagagactatttgagagggctcgcaagagggatcttgataggatcctcgatttgcttcttgacacgaatgacaaatattaatattaaaagacctcttgaattgatctcaggggtaatttcctatattctcctgaggctggataatcatccctctctgtatataatgcttagagaaccgtctcttagaggagagatattctctatccctcagaagatccccgccgcttacccaaccactatgaaagaaggcaacagatcgatcttgtgttacctccaacacgtgctacgctatgagcgagaagtaatcacggcgtccccggagaatgactggctgtggatcttctcagacttcagaagtgcgaaaatgacgtacttgaccctcattacctaccagtctcacctcctactccagagggttgagcgaaacttgtctaagagtatgagagctactctgcaacaaatgggttccttaatgaggcaagtgctgggtgggcacggagaagacaccttggagtcagacgacgacattcaacgattactaaaagactctttgcgaaggacgaggtgggtagatcaagaggtgcgccatgcagctagaaccatgagtggagattacagccccaacaagcttaagagccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaaatgcacactctgtatgctccaggtggctatgacatcatgggctatctggatcagatagggaatcgtcctaatccccaagtggaacttggaccagtagacactagctgtgcactgattctctgtgacctcaagcagaaggacacacccatcgtgtacgcctctgaagcgtttctgtacatgacaggctacagcaatgccgaagtcttggggagaaattgccgatttctgcagagtcctgacggtatggtcaaacccaagtcaacgaggaaatacgtcgattccaacaccatcaacaccattcggaaagccatcgatcggaatgctgaggtgcaagtggaggttgtgaacttcaagaagaacggacagaggttcgtgaacttcctgaccataattccggttagagatgagacaggagagtaccgctattccatggggttccagtgcgaaacagaatatccgtacgacgtcccagattacgcgggccttaaggtatctcgcaaggcaggatgttcagaatgggtctgctctgctcaacaggttgccgtctccacctcagccaacccggcccctgtctcagagcttgacattagggccctatctaagaggtttcaaaaccccttgatctcgggcctaagagtggttcagtgggcaaccggcgcccattataagctaaagcctattctagatgatctaaatgttttcccatctctctgtcttgttgttggagacgggtcagggggaatatcaagggcagttctcaacatgtttccagattctaagcttgtgttcaacagcctattggaggtgaatgatctgatggcttccggaacacgtccactgcctccttcagcaatcatgagtggaggagatgatatcatctccagagtgatagactttgactcaatctgggaaaaaccatccgacctgaggaacttggccacctggagatacttccagtcagttcaaaagcaggtcaacatgtcgtatgacctcattatttgtgatgcagaagttactgatattgcatctatcaaccggataactctgttgatgtctgatttcgcattgtctatagatggaccactttatctggtcttcaaaacttacgggactatgctagtgaacccagactataaagctatccaacatctgtcaagagcgttcccttcggtcacagggtttataacccaagtaacttcgtccttttcttctgagctgtacctccggttctccaaacgagggaagttttttagggatgctgagtacttgacctcttccacccttcgggagatgagccttgtgttattcaattgtagcagccccaaaagtgagatgcagagagctcgttccttaaactatcaagatcttgtaaggggatttcctgaagagatcatatcaaatccttacaatgaaatgatcataactctgattgacagtgatgtagagtccttcctggtccacaagatggtggatgatcttgagttacagaggggaactctgtctaaagtggctatcattatatccatcatgatcgttttttccaacagagtcttcaacatttccaaacctttgactgaccccttgttctatcccccatctgatcctaaaatcctgaggcacttcaacatatgttgcagtactatgatgtatctatctaccgctttaggcgacgtccctagcttcgcaagacttcatgacctatataatagacctataacttattacttcagaaagcaagttattcgagggaatatctatctatcttggagctggtccgatgacaccccagtgttcaagagggtagcctgtaattctagcttgagtctgtcatctcactggatcaggttgatttacaagatagtgaagactaccagactcgttggccgcatagaagatctatcaggagaggtagaacgacacctgcatgggtacaacagatggatcaccctcgaggatatccgatctagatcatccctactagactacagttgtttgtaagccggacattaatgaaagcctgtacatgctaaaattcttgtatgatgcatcttgaaaaaaacaagatcttgaatcagaacctctggttgtttgattgttttttttatctttattgtttatttgttaagcgtgggtcggcatggcatctccacctcctcgcggtccgacctgggcatccgaaggaggacgcacgtccactcggatggctaagggagggcgggtaccacgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgctgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagtgttaagcgtctgatgagtccgtgaggacgaaactataggaaaggaattcctatagtc

SEQ ID NO: 85 - DNA, 16992 bp, Artificial Sequence
  pHEP-pMag-linker-nMag
acgcttaacaacaaaaccaaagaagaagcagacatcgtcagttgcaaagcaaaaatgtaacacccctacaatggatgccgacaagattgtgttcaaagtcaataaccgggtggtctctttgaagcccgagattatcgtggatcaatatgagtacaagtaccctgctatcaaagatttgaaaaagccttgtataaccctagggaaagcccccgatttaaacaaagcttacaaatcagttttatcaggcatgaatgccgccaaacttgatcctgatgatgtatgctcctacttggcagcagcaatgcagttctttgaggggacatgtccggaagactggaccagctatggaatcctgattgcacgaaaaggagacaagatcaccccagactctctagtggagataaagcgtactgatgtagaagggaattgggctctgacaggaggcatggaactgacaagggaccccactgtctctgaacatgcatctttagtcggtcttctcctgagtctgtacagattgagcaaaatatcaggacaaaacactggtaactataagacaaacattgcggatagaatagagcagattttcgagacagccccttttgttaagatcgtggaacaccacaccctgatgacaactcacaagatgtgtgctaattggagtactataccgaacttcagatttttggccggaacctacgacatgtttttctcacggatcgagcatctgtattcggcaatcagagtgggcacagttgtcaccgcttatgaagactgctcaggactggtatcgtttacagggttcataaagcagatcattctcaccgcaagagaagcaatactatatttcttccacaagaactttgaagaagagataaggagaatgtttgagccagggcaagagacagctgttcctcactcttatttcatccacttccgttcactaggcttgagtgggaagtctccttattcatcaaatgccgtcggtcatgtgttcaatctcattcactttgttggatgctatatgggtcaagtcagatctctaaatgccacggttattgctgcatgtgcccctcatgagatgtctgttctagggggctatttgggagaggagttcttcggaaaagggacatttgaaagaaggttcttcagagacgagaaagaacttcaagaatatgaggcggctgaactgacaaagaccgacgtggcactggcagatgacggaactgtcaactccgatgacgaggactacttctccggtgaaaccagaagtcctgaagctgtctatactcgaatcatgatgaatggaggtcgactgaagagatcacatatacggagatatgtctcagtcagttccaatcatcaagcccgtccaaactcattcgccgaatttttaaacaaaacgtattcgagtgactcataaggagttgaatgacagggtgccagaaatccatagattgtgtatatccatcatgaaaaaaactaacactcctcctttcgaaccatcccaagtatgagcaagatctttgttaatccgagtgcaatcagagccggtctggccgatcttgagatggccgaagagactgttgatctgatcaacagaaacatagaagacaatcaggctcatctccagggagaacccatagaagtggacaatctccctgaggacatgaggcaatttcacctggacgatgaaaaattgtccaaccttggtgagatggttagggtgggcgaaggcaagtatcgagaggactttcagatgaatgagggagaggaccccaacctcctgttccaatcgtacctggacaatgttggagtccaaatagtcagacaaatgaggtcaggagagagattcctcaagatatggtcacagaccgtagaggaaattatatcctatgtctcggtcaactttcctaaccctccaggaaggtcttcggaggataaatcaacccaaactactggccgggagctcaagaaggagacaacatccattctttctcaaagagaaagccaaccttcaaaagccggaatggtggctcaagttgcctctggccctccatcccttgaatggtctgccaccaatggagaggatgatctatcagtagaggctgagatcgctcatcagattgctgaaagcttttccaagaagtacaagtttccttctcgatcttcaggaatattcttgtataattttgagcaactggagatgaaccttgatgacatagttaaagaggcaaaaaatgtaccgggcgtgacccgtctggcccatgatggatccaaaatccccctaagatgtgtactgggatgggtcgctttggccaactccaagaaattccaattgctagtcgaggccgacaagctaagcaaaatcatgcaagatgacttggatcgctacacatcatgctaaccgagtcttcgaattcattccctctagataatgaaaactgagatgtcatggagtcgatatgaaaaaaacaggcaacaccactaataaaatgaactttctatgtaagatagtgaaaaactgtagggatgaggacacccaaaagccctctcccgcgtcagcccctccggatggcgatgacctgtggcttccacctccagaatatgtcccgctgaaagaactcacaagcaagaagaacatgaggaacttttgtatcaacggggaggttaaagtgtgcagtccgaacggttactcattcaggatcctgcggcatattctgagatcattcgacgagatatactctgggaatcataggatgattgggttagtcaaagttgttgttggactagctttatcaggagctccagctcctgagggcatgaactgggtatacaaattgaggagaacccttattttccagtgggctgattccaggggccctcttgaaggggaggagttggaacactctcaagagatcacttgggacgatgatactgaattcgtcggattgcaaatgagagtgagcgcaagacaatgtcatattcaaggcaggatctggtgtatcgacatgaactcgagggcatgtcaactatggtctgacatgtctcttcagacacaaaggtctgaagaggacaaagactcttctctgcttttagaataatcagataatatcccgcaagttcatcacttgtttacttctggaggagagaacatacgggcttaactccaatccttgggagcaatagaacaaaaaaacacgttatgatgccattaaaccgctgcattttatcaaagtcaagttaattaccgttacattttgagcctcttggatgtgaaaaaaactattaacatccctcaaaagacttaaggaaagatggttcctcaggttcttttgtttgcacccctcctggtttctccattgtgtttcgggaagttccccatttacacgataccagacaaacttggtccctggagccctattgacttacaccatctcagctgtccaaataacctggttgtggaggacgaaggatgtaccaacctgtccgggttctcttacatggaacttaaagtgggatacatctcagccataaaagtgaacgggttcacttgcacaggtgttgtgacagaggcagaaacctacaccaactttgttggttatgtcacaaccacattcaagagaaagcatttccgccccaccccagacgcatgtagagccgcgtataactggaagatggccggtgaccccagatatgaagagtctctacacaatccgtaccccgactaccattggcttcgaactgtaaaaaccaccaaagagtctctcgttatcatatccccaagtgtgacagatttggacccatatgacaaatcccttcactcaagggtcttccctggcggaaattgctcaggaataacggtgtcctcgacctactgctcaactaatcatgattacaccatctggatgcctgagaatctgagactagggacatcttgtgacatttttacccatagcagagggaagagagcatccaaaggagacaagacttgcggctttgtggatgaaagaggcctgtataagtctttaaagggagcatgcaaactcaagttatgtggagttctcggacttagacttatggatggaacatgggtcgcgatgcaaacatcagatgagaccaaatggtgccctccaggtcagttggtgaatttgcacgactttcgctcagacgagattgagcatctcgttgaggaagagttagtcaagaaaagagaggagtgtctggatgcactagagtccatcatgaccaccaagtcagtgagtttcagacgtctcagtcacctgagaaaacttgtccctgggtttggaaaagcatataccatattcaacaaaaccttgatggaggctgatgctcactacaagtctgtccagacctggaatgagatcatcccctcaaaagggtgtttgagagttggggagaggtgtcatccccatgtgaacggggtgtttttcaatggtataatattagggtctgacggccatgttctaatcccagagatgcagtcatccctcctccagcaacatatggagttgttggaatcttcagttatccccctgatgcaccccttggcagacccttctacagttttcaaagacggtgatgaggttgaggattttgttgaagttcacctccccgatgtgcataaacaggtctcaggagttgacctgggtctcccgaaatgggggaagtatgtattgatgattgcaggggccttgattgccctgatgttgataattttcctgatgacatgttgcagaagagtcaatcgaccagaatctacacaaagcaatcttggagggacagggagaaatgtgtcagtcccttcccaaagcggaaaagtcatatcttcatgggagtcatataagagtggaggcgagaccagactgtgaaggccggtcatccttttgacacctcaagtccagaggataacctcctcccggggaaaaaaactaacacctctcgtacgaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaactgcagtttgctagcaggaccggtacataactataaagggctgggtcatctaagcatttcagtcgagaaaaaaactgtataccaaaagaacaactaacaacacttctcatctcgagacccatatcaagatgctggatccgggagaggtttatgatgaccctattgatccaattgagtcagaggctgaacccagaggaacccccactgtccccaacatcttgaggaactctgactacaatctcaactctcctttgattgaggactctgccaaactaatgttagaatggttgaaaacagggaacagaccttatcggatgactttgacagacaattgctccaggtcttacaaagatttgaaagattatttcaagaaagtagatttgggttctctcaaagtgggaggaactgctgcacaatcaatgatttctctctggttgtatggagcccactctgagtcaaacaggagccggagatgtataaccgacttggcccatttctattccaagtcatcccccatagagaagctgttgaattgtacgttaggaaacagaggcctgagaatcccaccagagggggtgttaagttgccttgagagggtcgattatgataaggcatttgggaggtatctggccaacacgcattcctcttatctgtttttccatgtaattaccttatacatgaatgccctagactgggaagaggaaaaaaccatcctagcattatggaaagatctaacctcagtggacaccgggaaggacttggtcaaattcaaagatcaaatatggggactgctgattgtgacaaaggactttgtttactctcagagttctaactgtctttttgacagaaactatacactgatgctaaaggatcttttcttgtctcgattcaactccttgatgattttgctttctccccctgagccccgatactcagatgacttaatatctcagctgtgccagctatacatcgctggggatcaagtcttgtccttgtgtgggaactccggctatgaagtcatcaaaatattggagccatatgtcgtgaacagtttggtccagagggcagagaagtttaggcctctcatccactccttgggagactttcctatgtttataaaagacaaggtgaatcaacttgaagggactttcggtcccagtgcaaaaaggttttttagggttctagatcaattcgacaacatacatgatctagtatttgtgtatggctgttacagacattgggggcacccctatatagattatcggaagggtctgttgaaactatatgatcaagttcacattaagaaagtaatagataagtcctaccaggagtgtttagcaagtgacttggctagaaggatcctcagatggggatttgacaagtactccaagtggtatctagattcgagattccttgcccgagaccaccccttggctccttatatcaagacccaaacatggccacccaaacatatagtagacttggtgggggacacatggcacaagctcccgatcacgcagatctttgagattcctgaatcaatggacccgtcagagatactggatgataaatcacattctttcaccagaacaagactagcttcttggctgtcagagaaccgaggggggcctgttcctagcgagaaggtcattatcacggccctgtctcagccacctgtcaatccccgagagtttttgaaatctatcgacctcggaggattgccagatgatgacttgataattggcctcagaccaaaggaacgggagttgaagattgagggccgattcttcgctctaatgtcatggaatctaagattatattttgtcatcaccgagaagctcttggccaactacattttgccactttttgacgcactgactatgacagacaacctgaacaaggtatttaaaaagttgatcgacagggtcaccgggcaagggcttttggactattcgagggtcacttacgcatttcacctggactatgagaaatggaacaatcatcaaagattggagtcaacggaggatgtattttctgtcctagatcaggtgtttggattgaagagggtgttttctagaacacacgagttttttcagaagtcctggatctattattcagacagatcagacctcattgggttacgggaggatcagatatattgcttggatatgtccaatggtccaacctgctggaatggccaagacggcgggctagagggcttacggcagaagggctggagtctagtcagcttattgatgatagatagagaatctcaaaccaggaacacaagaaccaagatactagctcaaggagacaaccaggttctgtgtccgacatacatgttgtcaccgggattgtctcaagaggggcttctctatgagttagagagcatatcgaggaatgcactctcaatataccgagctatcgaggaaggagcatctaaactggggctgatcatcaagaaagaagagaccatgtgtagttatgactttctcatatatgggaagacccccttatttcgaggcaacatattagtacctgaatccaaaagatgggcccgagtctcttgcatctctaacgaccaaatagtcaacctcgccaatataatgtctacagtatccaccaatgcgctgacagtggcacaacactctcaatctctgatcaaacctatgagggattttctgctcatgtcagtacaggcagttttccactacctgctgtttagcccaatcttaaaaggcagggtttataagattctgagtgctgaaggggagagctttctcctagccatgtcgcggataatctatctagatccttctttgggaggggtgtctggaatgtctctcgggaggttccatatacgtcagttctcagaccctgtctctgaagggttgtcattctggagagagatctggttaagctcccacgaatcctggattcacgcgttgtgtcaagaggccgggaaccccgatcttggagagagaacactagagagcttcactcgccttttagaagatcctactaccttaaatatcaaaggaggggccagtcctaccattctactcaaggatgctatcagaaaggctctgtacgacgaggtggacaaggtggaaaattcagagtttcgagaggcaatcctgttgtccaagacccatagagataactttatactctttttaaaatctgttgagcctctgttccctcgatttctcagtgaactcttcagttcgtccttcttgggaataccagagtcaattattggactgatacaaaactccaggacaataagaaggcagtttagaaagagtctctcaagaactttagaagagtccttctacaactcagagatccacgggattaatcggatgacccagacacctcaaagggtcgggagagtgtggccctgctcttcagagagggcagatctacttagggagatctcttggggaaggaaagtggtgggcacgacagttcctcacccttccgagatgttggggctgcttccaaaatcctctatttcctgcacttgtggagcaacagggggaggcaatcctagagtttctgtatcagtactcccgtccttcgatcagtcatttttttcacgaggtcctctaaagggatacttgggctcgtccacctccatgtcaacccagctattccatgcatgggaaaaagtcactaatgttcatgtggtgaaaagggctatatcgttaaaagaatctataaactggttcatcaatagaaattccaatttggctcaaactctaattagaaacatcatgtctctgacaggccctgatttctctctagaagaggctcctgttttcaaacggacagggtcagccttgcataggttcaagtctgccagatacagcgaaggagggtattcttctgtttgtcctaaccttctctctcatatctctgtcagtacagacactatgtctgatttgacccaagacgggaagaactatgatttcatgtttcagccattgatgctttatgcgcaaacatggacatcagagctggtacagagagacacaagactgagagactccacgtttcactggcaccttcgatgcaacagatgtgtaaggcccattgaggatataacactggaaacttctcagatcttcgagttcccggatgtgtcaaaaaggatatccaggatggtttctggagccgtccctcactttcagaagcttcctgatatccgtctaagaccaggtgattttgaatctctaagtggtagagaaaagtctcgccacatagggtcagctcaggggctcttatactcaatcttagtagcaattcacgattcaggatacaatgatgggaccatcttccctgtcaacatatacggcaaggtttcccctagagactatttgagagggctcgcaagagggatcttgataggatcctcgatttgcttcttgacacgaatgacaaatattaatattaaaagacctcttgaattgatctcaggggtaatttcctatattctcctgaggctggataatcatccctctctgtatataatgcttagagaaccgtctcttagaggagagatattctctatccctcagaagatccccgccgcttacccaaccactatgaaagaaggcaacagatcgatcttgtgttacctccaacacgtgctacgctatgagcgagaagtaatcacggcgtccccggagaatgactggctgtggatcttctcagacttcagaagtgcgaaaatgacgtacttgaccctcattacctaccagtctcacctcctactccagagggttgagcgaaacttgtctaagagtatgagagctactctgcaacaaatgggttccttaatgaggcaagtgctgggtgggcacggagaagacaccttggagtcagacgacgacattcaacgattactaaaagactctttgcgaaggacgaggtgggtagatcaagaggtgcgccatgcagctagaaccatgagtggagattacagccccaacaagcttaagagccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaaaccggtaattccgctgacggcggcggaggatcgggtggtagtggtggttcaggaggaggatcgacccaaggaggatccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatatccgtacgacgtcccagattacgcgggccttaaggtatctcgcaaggcaggatgttcagaatgggtctgttctgctcaacaggttgccgtctccacctcagccaacccggcccctgtctcagagcttgacattagggccctatctaagaggtttcaaaaccccttgatctcgggcctaagagtggttcagtgggcaaccggcgcccattataagctaaagcctattctagatgatctaaatgttttcccatctctctgtcttgttgttggagacgggtcagggggaatatcaagggcagttctcaacatgtttccagattctaagcttgtgttcaacagcctattggaggtgaatgatctgatggcttccggaacacgtccactgcctccttcagcaatcatgagtggaggagatgatatcatctccagagtgatagactttgactcaatctgggaaaaaccatccgacctgaggaacttggccacctggagatacttccagtcagttcaaaagcaggtcaacatgtcgtatgacctcattatttgtgatgcagaagttactgatattgcatctatcaaccggataactctgttgatgtctgatttcgcattgtctatagatggaccactttatctggtcttcaaaacttacgggactatgctagtgaacccagactataaagctatccaacatctgtcaagagcgttcccttcggtcacagggtttataacccaagtaacttcgtccttttcttctgagctgtacctccggttctccaaacgagggaagttttttagggatgctgagtacttgacctcttccacccttcgggagatgagccttgtgttattcaattgtagcagccccaaaagtgagatgcagagagctcgttccttaaactatcaagatcttgtaaggggatttcctgaagagatcatatcaaatccttacaatgaaatgatcataactctgattgacagtgatgtagagtccttcctggtccacaagatggtggatgatcttgagttacagaggggaactctgtctaaagtggctatcattatatccatcatgatcgttttttccaacagagtcttcaacatttccaaacctttgactgaccccttgttctatcccccatctgatcctaaaatcctgaggcacttcaacatatgttgcagtactatgatgtatctatctaccgctttaggcgacgtccctagcttcgcaagacttcatgacctatataatagacctataacttattacttcagaaagcaagttattcgagggaatatctatctatcttggagctggtccgatgacaccccagtgttcaagagggtagcctgtaattctagcttgagtctgtcatctcactggatcaggttgatttacaagatagtgaagactaccagactcgttggccgcatagaagatctatcaggagaggtagaacgacacctgcatgggtacaacagatggatcaccctcgaggatatccgatctagatcatccctactagactacagttgtttgtaagccggacattaatgaaagcctgtacatgctaaaattcttgtatgatgcatcttgaaaaaaacaagatcttgaatcagaacctctggttgtttgattgttttttttatctttattgtttatttgttaagcgtgggtcggcatggcatctccacctcctcgcggtccgacctgggcatccgaaggaggacgcacgtccactcggatggctaagggagggcgggtaccacgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgctgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagtgttaagcgtctgatgagtccgtgaggacgaaactataggaaaggaattcctatagtc

SEQ ID NO: 86 - DNA, 8976 bp, Artificial Sequence
  Oct3-measles-Sox2-l-myc
accaaacaaagttgggtaaggatagatcaatcaatgatcatattctagtacacttaggattcaagatcctattatcagggacaagagcaggattagggatatccgagggcgcgccatggcgggacacctggcttcagattttgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacattgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgataagacgtcgagaggccgaggaccagaacaacatccgcctaccctccatcattgttataaaaaacttaggaaccaggtccacacagccgccagccaaccaaccatccactcccacgactggagttcgaacgagatggccacacttttgaggagcttagcattgttcaaaagaaacaaggacaaaccacccattacatcaggatccggtggagccatcagaggaatcaaacacattattatagtaccaattcctggagattcctcaattaccactcgatccagactactggaccggttggtcaggttaattggaaacccggatgtgagcgggcccaaactaacaggggcactaataggtatattatccttatttgtggagtctccaggtcaattgattcagaggatcaccgatgaccctgacgttagcatcaggctgttagaggttgttcagagtgaccagtcacaatctggccttaccttcgcatcaagaggtaccaacatggaggatgaggcggaccaatacttttcacatgatgatccaagcagtagtgatcaatccaggtccggatggttcgagaacaaggaaatctcagatattgaagtgcaagaccctgagggattcaacatgattctgggtaccattctagcccagatctgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctctttacgccgattcatggtggctctaatcctggatatcaagaggacacccgggaacaaacctaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaatctttaccagcaaatgggagaaactgcaccctacatggtaatcctagagaactcaattcagaacaagttcagtgcaggatcataccctctgctctggagctatgccatgggagtaggagtggaacttgaaaactccatgggaggtttgaactttggtcgatcttactttgatccagcatattttagattagggcaagagatggtgaggaggtcagctggaaaggtcagttccacattggcatccgaactcggtatcactgccgaggatgcaaggcttgtttcagagattgcaatgcatactactgaggacaggatcagtagagcggtcggacccagacaagcccaagtgtcatttctacacggtgatcaaagtgagaatgagctaccaggattggggggcaaggaagataggagggtcaaacagggtcggggagaagccagggagagctacagagaaaccgggtccagcagagcaagtgatgcgagagctgcccatcctccaaccagcatgcccctagacattgacactgcatcggagtcaggccaagatccgcaggacagtcgaaggtcagctgacgccctgctcaggctgcaagccatggcaggaatcttggaagaacaaggctcagacacggacacccctagggtatacaatgacagagatcttctagactaggtgcgagaggccgaggaccagaacaacatccgcctaccctccatcattgttataaaaaacttaggaaccaggtccacacagccgccagccaaccaaccatccactcccacgactggagccgatggcagaagagcaggcacgccatgtcaaaaacggactggaatgcatccgggctctcaaggccgagcccatcggctcactggccgtcgaggaagccatggcagcatggtcagaaatatcagacaacccaggacaggaccgagccacctgcaaggaagaggaggcaggcagttcgggtctcagcaaaccatgcctctcagcaattggatcaactgaaggcggtgcacctcgcatccgcggtcagggatctggagaaagcgatgacgacgctgaaactttgggaatcccctcaagaaatctccaggcatcaagcactgggttacagtgttatcatgtttatgatcacagcggtgaagcggttaagggaatccaagatgctgactctatcatggttcaatcaggccttgatggtgatagcaccctctcaggaggagacgatgaatctgaaaacagcgatgtggatattggcgaacctgataccgagggatatgctatcactgaccggggatctgctcccatctctatggggttcagggcttctgatgttgaaactgcagaaggaggggagatccacgagctcctgaaactccaatccagaggcaacaactttccgaagcttgggaaaactctcaatgttcctccgcccccgaaccccagtagggccagcacttccgagacacccattaaaaagggcacagacgcgagattggcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctccgatgtccaagacatcaaaacagccttggccaaaatacacgaggataatcagaagataatctccaagctagaatcattgctgttattgaagggagaagttgagtcaattaagaagcagatcaacaggcaaaatatcagcatatccaccctggaaggacacctctcaagcatcatgattgccattcctggacttgggaaggatcccaacgaccccactgcagatgtcgaactcaatcccgacctgaaacccatcataggcagagattcaggccgagcactggccgaagttctcaagaagcccgttgccagccgacaactccagggaatgactaatggacggaccagttccagaggacagctgctgaaggaatttcaactaaagccgatcgggaaaaaggtgagctcagccgtcgggtttgttcctgacaccggccctgcatcacgcagtgtaatccgctccattataaaatccagccggctagaggaggatcggaagcgttacctgatgactctccttgatgatatcaaaggagccaacgatcttgccaagttccaccagatgctgatgaagataataatgaagtagctacagctcaacttacctgccaaccccatgccagtcgacctaattagtacaacctaaatccattataaaaaacttaggagcaaagtgattgcctcctaagttccacaatgacagagatctacgatttcgacaagtcggcatgggacatcaaagggtcgatcgctccgatacaacctaccacctacagtgatggcaggctggtgccccaggtcagagtcatagatcctggtctaggtgataggaaggatgaatgctttatgtacatgtttctgctgggggttgttgaggacagcgattccctagggcctccaatcgggcgagcattcgggtccctgcccttaggtgttggtagatccacagcaaaacccgagaaactcctcaaagaggccactgagcttgacatagttgttagacgtacagcagggctcaatgaaaaactggtgttctacaacaacaccccactaaccctcctcacaccttggagaaaggtcctaacaacagggagtgtcttcaatgcaaaccaagtgtgcaatgcggttaatctaataccgctggacaccccgcagaggttccgtgttgtttatatgagcatcacccgtctttcggataacgggtattacaccgttcccagaagaatgctggaattcagatcggtcaatgcagtggccttcaacctgctagtgacccttaggattgacaaggcgattggccctgggaagatcatcgacaatgcagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccactgatggatatcaatgaagaccttaatcggttactctggaggagcagatgcaagatagtaagaatccaggcagttttgcagccatcagttcctcaagaattccgcatttacgacgacgtgatcataaatgatgaccaaggactattcaaagttctgtagaccgcagtgcccagcaatacccgaaaacgacccccctcataatgacagccagaaggcccggacaaaaaagccccctccagaagactccacggaccaagcgagaggccagccagcagccgacagcaagtgtggacaccaggcggcccaagcacagaacagccccgacacaaggccaccaccagccatcccaatctgcgtcctcctcgtgggacccccgaggaccaaccccgaaggtcgctccgaacacagaccaccaaccgcatccccacagctcccgggaaaggaacccccagcaactggaaggcccctccccccctcccccaacgcaagaaccccacaaccgaaccgcacaagcgaccgaggtgacccaaccgcaggcatccgactccttagacagatcctctccccccggcatactaaacaaaacttagggccaaggaacacacacactcgacagaacccagaccccggcccgcggcaccgcgcccccaccccccgaaaaccagagggagcccccaaccaaacccgccggcccccccggtgcccacaggtaggcacaccaacccccgaccagacccagcacccagccaccgacaatccaagacggggggccccccccaaaaaaaggcccccaggggccgacagccagcatcgatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgataacggtcctcccatatcattggagaggttggacgtagggacaaatctggggaatgcaattgctaagttggaggatgccaaggaattgttggagtcatcggaccagatattgaggagtatgaaaggtttatcgagcactagcatagtttacatcctgattgcagtgtgtcttggagggttgatagggatccccgctttaatatgttgctgcagggggcgctgtaacaaaaagggagaacaagttggtatgtcaagaccaggcctaaagcctgatcttacagggacatcaaaatcctatgtaaggtcgctctgatcctctacaactcttgaaacacagatttcccacaagtctcctcttcgtcatcaagcaaccaccgcatccagcatcaagcccacctgaaattgtctccggcttccctctggccgaacgatatcggtagttaattaaaacttagggtgcaagatcatccacaatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcggagaatgaagaaattgatgttgtgacagtagagaagaggcagtctctgggtattcggaagccggtcaccatcacggtgcgagcagaccccctggatccctgcatgaagcatttccacatctccatccatcagcaacagcacaactatgctgcccgttttcctccagaaagctgctcccaagaagaggcttcagagaggggtccccaagaagaggttctggagagagatgctgcaggggaaaaggaagatgaggaggatgaagagattgtgagtcccccacctgtagaaagtgaggctgcccagtcctgccaccccaaacctgtcagttctgatactgaggatgtgaccaagaggaagaatcacaacttcctggagcgcaagaggcggaatgacctgcgttcgcgattcttggcgctgagggaccaggtgcccaccctggccagctgctccaaggcccccaaagtagtgatcctaagcaaggccttggaatacttgcaagccctggtgggggctgagaagaggatggctacagagaaaagacagctccgatgccggcagcagcagttgcagaaaagaattgcatacctcactggctactaatagcgctctgattaaggattaattggttgaactccggaaccctaatcctgccctaggtagttaggcattatttgcaatatattaaagaaaactttgaaaatacgaagtttctattcccagctttgtctggt

SEQ ID NO: 87 - DNA, 12102 bp, Artificial Sequence
  egfp-klf4-measles-L-pMag-linker-nMaghigh
accaaacaaagttgggtaaggatagatcaatcaatgatcatattctagtacacttaggattcaagatcctattatcagggacaagagcaggattagggatatccgagggcgcgccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaagacgtcgagaggccgaggaccagaacaacatccgcctaccctccatcattgttataaaaaacttaggaaccaggtccacacagccgccagccaaccaaccatccactcccacgactggagttcgaagcagatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaataggacgtcgagaggccgaggaccagaacaacatccgcctacgatatcggtagttaattaaaacttagggtgcaagatcatccacaatgtcaccacaacgagaccgaataaatgccttctacaaagacaacccacatcctaagggaagtaggatagttattaacagagaacatcttatgattgatagaccttatgttttgctggctgttctattcgtcatgtttctgagcttgatcgggttgctagccattgcaggcattagactccatcgtgcagccatctacaccgcagagatccataagagcctcagcaccaatctagatgtaactaactcgatcgagcatcaggtcaaggacgtgctgacaccactcttcaagatcattggtgatgaagtgggcctgaggacacctcagagattcactgacctagtgaaattcatctctgacaaaattaaattccttaatccggatagggagtacgacttcagagatctcacttggtgtatcaacccgccagagagaatcaaattggattatgatcaatactgtgcagatgtggctgctgaagaactcatgaatgcattggtgaactcaactctactggaggccagggcaaccaatcagttcctagctgtctcaaagggaaactgctcagggcccactacaatcagaggtcaattctcaaacatgtcgctgtccctgttggacttgtatttaagtcgaggttacaatgtgtcatctatagtcactatgacatcccagggaatgtacgggggaacttacctagtgggaaagcctaatctgagcagtaaagggtcagagttgtcacaactgagcatgcaccgagtgtttgaagtaggggttatcagaaatccgggtttgggggctccggtgttccatatgacaaactattttgagcaaccagtcagtaatgatttcagcaactgcatggtggctttgggggagcttaaattcgcagccctctgtcacagggaagattctatcacaattccctatcaggggtcagggaaaggtgtcagcttccagctcgtcaagctaggtgtctggaaatccccaaccgacatgcgatcctgggtccccctatcaacggatgatccagtgatagataggctttatctctcatctcacagaggtgttatcgctgacaatcaagcaaaatgggctgtcccgacaacacggacagatgacaagttgcgaatggagacatgcttccagcaggcgtgtaagggtaaaatacaagcactctgcgagaatcccgagtgggcaccattgaaggataacaggattccttcatacggggtcttgtctgttgacctgagtctgacagttgagcttaaaatcaaaattgcttcaggattcgggccattgatcacacacggttcagggatggacctatacaaaaccaaccacaacaatgtgtattggctgactatcccgccaatgaagaacctagccttaggtgtaatcaacacattggagtggataccgagattcaaggttagtccctatctcttcactgttccaatcaaggaagcaggcggcgactgccatgccccaacatacctacctgcggaggtggatggtgatgtcaaactcagttccaatctggtaattctacctggtcaggatctccaatatgttttggcaacctacgatacttccagggttgaacatgctgtggtttattatgtttacagcccaagccgctcattttcttacttttatccttttaggttgcctataaagggggtcccaatcgaattacaagtggaatgcttcacatgggacaaaaaactctggtgccgtcacttctgtgtgcttgcggactcagaatctggtggacatatcactcactctgggatggtgggcatgggagtcagctgcacagtcactcgggaagatggaaccaatcgcagatagggctgccagtgaaccgatcacatgatgtcacccagacatcaggcatacccactagtgtgaaatagacatcagaattaagaaaaacgtagggtccaagtggtttcccgttatggactcgctatctgtcaaccagatcttataccctgaagttcacctagatagcccgatagttaccaataagatagtagctatcctggagtatgctcgagtccctcacgcttacagcctggaggaccctacactgtgtcagaacatcaagcaccgcctaaaaaacggattctccaaccaaatgattataaacaatgtggaagttgggaatgtcatcaagtccaagcttaggagttatccggcccactctcatattccatatccaaattgtaatcaggatttatttaacatagaagacaaagagtcaacaaggaagatccgtgagctcctaaaaaagggaaattcgctgtactccaaagtcagtgataaggttttccaatgcctgagggacactaactcacggcttggcctaggctccgaattgagggaggacatcaaggagaaaattattaacttgggagtttacatgcacagctcccaatggtttgagccctttctgttttggtttacagtcaagactgagatgaggtcagtgattaaatcacaaacccatacttgccataggaggagacacacacctgtattcttcactggtagttcagttgagctgttaatctctcgtgaccttgttgctataatcagtaaggaatctcaacatgtatattacctgacgtttgaactggttttgatgtattgtgatgtcatagaggggaggttaatgacagagaccgctatgaccattgatgctaggtatgcagaacttctaggaagagtcagatacatgtggaaactgatagatggtttcttccctgcactcgggaatccaacttatcaaattgtagccatgctggagccactttcacttgcttacctgcaactgagggatataacagtagaactcagaggtgctttccttaaccactgctttactgaaatacatgatgttcttgaccaaaacgggttttctgatgaaggtacttatcatgagttaattgaagccctagattacattttcataactgatgacatacatctgacaggggagattttctcatttttcagaagtttcggccaccccagacttgaagcagtaacggctgctgaaaatgtcaggaaatacatgaatcagcctaaagtcattgtgtatgagactctgatgaaaggtcatgccatattttgtggaatcataatcaacggctatcgtgacaggcacggaggcagttggccacccctgaccctccccctgcatgctgcagacacaatccggaatgctcaagcttcaggtgaagggttaacacatgagcagtgcgttgataactggaaatcatttgctggagtgagatttggctgttttatgcctcttagcctggacagtgatctgacaatgtacctaaaggacaaggcacttgctgctctccaaagggaatgggattcagtttacccgaaagagttcctgcgttacgatcctcccaagggaaccgggtcacggaggcttgtagatgttttccttaatgattcgagctttgacccatatgatatgataatgtatgtcgtaagtggagcctacctccatgaccctgagttcaacctgtcttacagcctgaaagaaaaggagatcaaggaaacaggtagacttttcgctaaaatgacttacaaaatgagggcatgccaagtgatcgctgaaaatctaatctcaaacgggattggcaagtattttaaggacaatgggatggccaaggatgagcacgatttgactaaggcactccacactctggctgtctcaggagtccccaaagatctcaaagaaagtcacaggggggggccagtcttaaaaacctactcccgaagcccagtccacacaagtaccaggaacgttaaagcagaaaaagggtttgtaggattccctcatgtaattcggcagaatcaagacactgatcatccggagaatatagaaacctacgagacagtcagcgcatttatcacgactgatctcaagaagtactgccttaattggagatatgagaccatcagcttatttgcacagaggctaaatgagatttacggattaccctcattttttcagtggctgcataagaggcttgaaacctctgtcctctatgtaagtgaccctcattgcccccccgaccttgacgcccatgtcccgttatgcaaagtccccaatgaccaaatcttcatcaagtaccctatgggaggtatagaagggtattgtcagaagctgtggaccatcagcaccattccctacttatacctggctgcttatgagagcggggtaaggattgcttcgttagtgcaaggggacaatcagaccatagccgtaacaaaaagggtacccagcacatggccttacaaccttaagaaacgggaagctgctagagtaactagagattactttgtaattcttaggcaaaggctacatgacattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcggcatgcagtaatattgctacaacaatggccaaaagcattgagagaggttatgaccgttatcttgcatattccctgaacgtcctaaaagtgatacagcaaattttgatctcccttggcttcacaatcaattcaaccatgacccgggatgtagtcatacccctcctcacaaacaacgatctcttaataaggatggcactgttgcccgctcctattgggggtatgaattatctgaatatgagcaggctgtttgtcagaaacatcggtgatccagtaacatcatcaattgctgatctcaagagaatgattctcgcatcactaatgcctgaagagaccctccatcaagtaatgacacaacaaccgggggactcttcattcctagactgggctagcgacccttactcagcaaatcttgtatgcgtccagagcatcactagactcctcaagaacataactgcaaggtttgtcctgatccacagtccaaacccaatgttaaaagggttattccatgatgacagcaaagaagaggacgagagactggcggcattcctcatggacaggcatattatagtacctagggcagctcatgaaatcctggatcatagtgtcacaggggcaagagagtctattgcaggcatgctagataccacaaaaggcctgattcgagccagcatgaggaagggggggttaacctctcgagtgataaccagattgtccaattatgactatgaacaatttagagcagggatggtgctattgacaggaagaaagagaaatgtcctcattgacaaagagtcatgttcagtgcagctggctagagccctaagaagccatatgtgggcaagactagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagctcgccttcgtaagagccccaagtagatccttgcgatctgccgttagaatagcaacagtgtactcatgggcttacggtgatgatgatagctcttggaacgaagcctggttgttggcaaggcaaagggccaatgtgagcctggaggagctaagggtgatcactcccatctcgacttcgactaatttagcgcataggttgagggatcgtagcactcaagtgaaatactcaggtacatcccttgtccgagtggcaaggtataccacaatctccaacgacaatctctcatttgtcatatcagataagaaggttgatactaactttatataccaacaaggaatgcttctagggttgggtgttttagaaacattgtttcgactcgagaaagatactggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattctagctaagtccacagcactatctatgattgacctggtaacaaaatttgagaaggaccatatgaatgaaatttcagctctcataggggatgacgatatcaatagtttcataactgagtttctgcttatagagccaagattattcaccatctacttgggccagtgtgcagccatcaattgggcatttgatgtacattatcatagaccatcagggaaatatcagatgggtgagctgttgtcttcgttcctttctagaatgagcaaaggagtgtttaaggtgcttgtcaatgctctaagccacccaaagatctacaagaaattctggcattgtggtattatagagcctatccatggtccttcacttgatgctcaaaacttgcacacaactgtgtgcaacatggtttacacatgctatatgacctacctcgacctgttgttgaatgaagagttagaagagttcacatttcttttgtgtgaaagcgatgaggatgtagtaccggacagattcgacaacatccaggcaaaacacttgtgtgttctggcagatttgtactgtcaaccagggacctgcccaccgattcgaggtctaaggccggtagagaaatgtgcagttctaaccgatcatatcaaggcagaggctaggttatctccagcaggatcttcgtggaacataaatccaattattgtagaccattactcatgctctctgacttatctccgtcgaggatctatcaaacagataagattgagagttgatccaggattcatttttgacgccctcgctgaggtaaatgtcagtcagccaaaggtcggcagcgacgtcagccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaaaccggtaattccgctgacggcggcggaggatcgggtggtagtggtggttcaggaggaggatcgacccaaggaggatccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatccgcaaggcaatcgacaggaatgccgaggtgcaggttgaagtagtcaattttaaaaagaatggacagcgatttgttaatttcctgactatcatacctgttagggacgaaacaggcgagtatcgatactctatgggattccagtgcgaaacagaatatccgtacgacgtcccagattacgcgggcatctcaaatatgagcatcaaggatttcagacctccacacgatgatgttgcaaaattgctcaaagatatcaacacaagcaagcacaatcttcccatttcagggggtagtctcgccaattatgaaatccatgctttccgcagaatcgggttaaactcatctgcttgctacaaagctgttgagatatcaacattaattaggagatgccttgagccaggggaagacggcttgttcttgggtgaggggtcgggttctatgttgatcacttataaggagatactaaaactaaacaagtgcttctataatagtggggtttccgccaattctagatctggtcaaagggaattagcaccctatccctccgaagttggccttgtcgaacacagaatgggagtaggtaatattgtcaaggtgctctttaacgggaggcccgaagtcacgtgggtaggcagtatagattgcttcaatttcatagtcagtaatatccctacctctagtgtggggtttatccattcagatatagagaccttacctaacaaagatactatagagaagctagaggaattggcagccatcttatcgatggctctactccttggcaaaataggatcaatactggtgattaagcttatgcctttcagcggggattttgttcagggatttataagctatgtagggtctcattatagagaagtgaaccttgtctaccctaggtacagcaacttcatatctactgaatcttatttagttatgacagatctcaaagctaaccggctaatgaatcctgaaaagatcaagcagcagataattgaatcatctgtacggacttcacctggacttataggtcacatcctatccattaagcaactaagctgcatacaagcaattgtgggaggcgcggttagtagaggtgatatcaaccctattctgaaaaaacttacacctatagagcaggtgctgatcagttgcgggttggcaattaacggacctaaactgtgcaaagaattaatccaccatgatgttgcctcagggcaagatggattgcttaactctatactcatcctctacagggagttggcaagattcaaagacaaccaaagaagtcaacaagggatgttccacgcttaccccgtattggtaagtagtaggcaacgagaacttgtatctaggatcactcgcaaattttgggggcatattcttctttactccgggaacagaaagttgataaatcggtttatccagaatctcaagtccggttatctagtactagacttacaccagaatatcttcgttaagaatctatccaagtcagagaaacagattattatgacggggggtttaaaacgtgagtgggtttttaaggtaacagtcaaggagaccaaagaatggtacaagttagtcggatacagcgctctgattaaggattaattggttgaactccggaaccctaatcctgccctaggtagttaggcattatttgcaatatattaaagaaaactttgaaaatacgaagtttctattcccagctttgtctggt

The invention claimed is:

1. A virus protein gene in which a gene coding for an optical switch protein is inserted in an expressible manner in an exogenous gene-transferable region of a virus protein that has an enzyme activity, wherein the optical switch protein comprises at least two subunits, and the nucleic acid sequences encoding for the at least two subunits are linked together via a nucleic acid sequence encoding a linker, or are directly linked together without a linker.

2. The virus protein gene according to claim 1, wherein the linker has 10 to 100 amino acid residues.

3. The virus protein gene according to claim 1, wherein the gene coding for an optical switch protein is Magnet gene.

4. The virus protein gene according to claim 3, wherein the activity of the virus protein can be adjusted by irradiating light with a wavelength of 450 to 490 nm.

5. The virus protein gene according to claim 1, wherein the virus protein that has an enzyme activity is a virus protein having a polymerase or protease domain.

6. The virus protein gene according to claim 1, wherein the virus is an RNA virus.

7. The virus protein gene according to claim 1, wherein the virus protein is an RNA-dependent RNA polymerase.

8. The virus protein gene according to claim 7, wherein the RNA-dependent RNA polymerase is RNA-dependent RNA polymerase L protein.

9. The virus protein gene according to claim 7, wherein the exogenous gene-transferable region is a region between the Ln domain and the Lc domain.

10. The virus protein gene according to claim 1, which further includes a linker further upstream and/or downstream from the gene coding for an optical switch protein.

11. A nucleic acid encoding the virus protein gene according to claim 1.

12. A vector that includes a nucleic acid encoding the virus protein gene according to claim 1.

13. A virus or virus vector that includes the virus protein gene according to claim 1.

14. A kit that includes a nucleic acid according to claim 11.

15. Cells including a nucleic acid according to claim 11.

16. Cells according to claim 15, wherein the cells are iPS cells or their progeny cells.

17. A method for infecting cells transiently with a virus vector, comprising:
infecting the cells with a virus or virus vector according to claim 13 that includes a transgene,
culturing the infected cells under light irradiation, and
culturing the infected cells under no light irradiation.

18. A method for expressing a transgene, comprising:
infecting cells with a virus or virus vector according to claim 13 that includes a transgene, and
culturing the infected cells under light irradiation.

19. A method for producing iPS cells, comprising:
infecting somatic cells with a virus or virus vector according to claim 13 that includes one or more transgenes selected from the group consisting of Oct3/4, Sox2, Klf4, 1-Myc (or c-Myc), Nanog and Lin28, and
culturing the infected cells under light irradiation.

20. The method according to claim 18, which further includes a step of culturing the infected cells under no light irradiation.

* * * * *